(12) United States Patent
Swayze

(10) Patent No.: US 10,294,477 B2
(45) Date of Patent: May 21, 2019

(54) COMPOSITIONS AND METHODS FOR MODULATING PKK EXPRESSION

(71) Applicant: Ionis Pharmaceuticals, Inc., Carlsbad, CA (US)

(72) Inventor: Eric E. Swayze, Encinitas, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 15/308,027

(22) PCT Filed: May 1, 2015

(86) PCT No.: PCT/US2015/028765
§ 371 (c)(1),
(2) Date: Oct. 31, 2016

(87) PCT Pub. No.: WO2015/168532
PCT Pub. Date: Nov. 5, 2015

(65) Prior Publication Data
US 2017/0183661 A1    Jun. 29, 2017

Related U.S. Application Data

(60) Provisional application No. 62/088,459, filed on Dec. 5, 2014, provisional application No. 62/058,629, filed on Oct. 1, 2014, provisional application No. 61/987,478, filed on May 1, 2014.

(51) Int. Cl.
| | |
|---|---|
| *C07H 21/02* | (2006.01) |
| *A61K 31/70* | (2006.01) |
| *C12N 15/113* | (2010.01) |
| *C07H 21/00* | (2006.01) |
| *C12N 5/00* | (2006.01) |

(52) U.S. Cl.
CPC ......... *C12N 15/1137* (2013.01); *C07H 21/00* (2013.01); *C12N 2310/315* (2013.01); *C12N 2310/3341* (2013.01); *C12N 2310/341* (2013.01); *C12N 2310/351* (2013.01)

(58) Field of Classification Search
None
See application file for complete search history.

(56) References Cited

U.S. PATENT DOCUMENTS

| | | | |
|---|---|---|---|
| 4,153,687 A | 5/1979 | Schnabel et al. | |
| 4,973,668 A | 11/1990 | Jallat et al. | |
| 4,981,957 A | 1/1991 | Lebleu et al. | |
| 5,034,506 A | 7/1991 | Summerton et al. | |
| 5,118,800 A | 6/1992 | Smith et al. | |
| 5,166,315 A | 11/1992 | Summerton et al. | |
| 5,185,444 A | 2/1993 | Summerton et al. | |
| 5,319,080 A | 6/1994 | Leumann | |
| 5,359,044 A | 10/1994 | Cook et al. | |
| 5,393,878 A | 2/1995 | Leumann | |
| 5,446,137 A | 8/1995 | Maag et al. | |
| 5,466,786 A | 11/1995 | Buhr et al. | |
| 5,514,785 A | 5/1996 | Van Ness et al. | |
| 5,519,134 A | 5/1996 | Acevedo et al. | |
| 5,567,811 A | 10/1996 | Misiura et al. | |
| 5,576,427 A | 11/1996 | Cook et al. | |
| 5,591,722 A | 1/1997 | Montgomery et al. | |
| 5,597,909 A | 1/1997 | Urdea et al. | |
| 5,610,300 A | 3/1997 | Altmann et al. | |
| 5,627,053 A | 5/1997 | Usman et al. | |
| 5,639,873 A | 6/1997 | Barascut et al. | |
| 5,646,265 A | 7/1997 | McGee | |
| 5,670,633 A | 9/1997 | Cook et al. | |
| 5,698,685 A | 12/1997 | Summerton et al. | |
| 5,700,920 A | 12/1997 | Altmann et al. | |
| 5,786,328 A | 7/1998 | Dennis et al. | |
| 5,792,847 A | 8/1998 | Buhr et al. | |
| 5,801,154 A | 9/1998 | Baracchini et al. | |
| 6,268,490 B1 | 7/2001 | Imanishi et al. | |
| 6,525,191 B1 | 2/2003 | Ramasamy | |
| 6,582,908 B2 | 6/2003 | Fodor et al. | |
| 6,600,032 B1 | 7/2003 | Manoharan et al. | |
| 6,670,461 B1 | 12/2003 | Wengel et al. | |
| 6,770,748 B2 | 8/2004 | Imanishi et al. | |
| 6,794,499 B2 | 9/2004 | Wengel et al. | |
| 7,034,133 B2 | 4/2006 | Wengel et al. | |
| 7,053,207 B2 | 5/2006 | Wengel | |
| 7,235,530 B2 | 6/2007 | Blair et al. | |
| 7,262,177 B2 | 8/2007 | Ts'O et al. | |
| 7,399,845 B2 | 7/2008 | Seth et al. | |

(Continued)

FOREIGN PATENT DOCUMENTS

| | | |
|---|---|---|
| WO | WO 1994/014226 | 6/1994 |
| WO | WO 1996/014329 | 5/1996 |

(Continued)

OTHER PUBLICATIONS

Albaek et al., "Analogues of a Locked Nucleic Acid with Three-Carbon 2',4'-Linkages: Synthesis by Ring-Closing Metathesis and Influence of Nucleic Acid Duplex Stability" J. Org. Chem. (2006) 71:7731-7740.
Altmann et al., "Second-generation antisense oligonucleotides: structure-activity relationships and the design of improved signal-transduction inhibitors" Biochem. Soc. Trans. (1996) 24: 630-637.
Altmann et al., "Second Generation of Antisense Oligonucleotides: From Nuclease Resistance to Biological Efficacy in Animals" Chimia (1996) 50: 168-176.
Altmann et al., "Second Generation Antisense Oligonucleotides—Inhibition of PKC-α and c-raf Kinase Expression by Chimeric Oligonucleotides Incorporating 6"-Substituted Carbocyclic Nucleosides and 2"-O-Ethylene Glycol Substituted Ribonucleosides" Nucleosides Nucleotides (1997) 16(7-9): 917-926.

(Continued)

*Primary Examiner* — Sean McGarry
(74) *Attorney, Agent, or Firm* — McNeill Baur PLLC

(57) ABSTRACT

Disclosed herein are antisense compounds and methods for decreasing PKK mRNA and protein expression. Such methods, compounds, and compositions are useful to treat, prevent, or ameliorate PKK-associated diseases, disorders, and conditions.

21 Claims, No Drawings
Specification includes a Sequence Listing.

(56) References Cited

U.S. PATENT DOCUMENTS

| | | |
|---|---|---|
| 7,427,672 B2 | 9/2008 | Imanishi et al. |
| 7,547,684 B2 | 6/2009 | Seth et al. |
| 7,691,997 B2 | 4/2010 | Khvorova et al. |
| 7,696,345 B2 | 4/2010 | Allerson et al. |
| 7,741,457 B2 | 6/2010 | Seth et al. |
| 8,090,542 B2 | 1/2012 | Khvorova et al. |
| 8,106,022 B2 | 1/2012 | Manoharan et al. |
| 9,315,811 B2 | 4/2016 | Bhattacharjee et al. |
| 9,322,021 B2 | 4/2016 | Revenko et al. |
| 10,100,310 B2 | 10/2018 | Freier et al. |
| 2001/0053519 A1 | 12/2001 | Fodor et al. |
| 2002/0082227 A1 | 6/2002 | Henry et al. |
| 2003/0228597 A1 | 12/2003 | Cowsert et al. |
| 2004/0171570 A1 | 9/2004 | Allerson et al. |
| 2005/0089893 A1 | 4/2005 | Lopez et al. |
| 2005/0130923 A1 | 6/2005 | Bhat et al. |
| 2005/0221354 A1 | 10/2005 | Mounts et al. |
| 2005/0245475 A1 | 11/2005 | Khvorova et al. |
| 2005/0246794 A1 | 11/2005 | Khvorova et al. |
| 2005/0255487 A1 | 11/2005 | Khvorova et al. |
| 2005/0287570 A1 | 12/2005 | Mounts |
| 2006/0069020 A1 | 3/2006 | Blair et al. |
| 2006/0185027 A1 | 8/2006 | Bartel et al. |
| 2006/0264603 A1 | 11/2006 | Markland et al. |
| 2007/0031844 A1 | 2/2007 | Khvorova et al. |
| 2007/0039072 A1 | 2/2007 | Khvorova et al. |
| 2007/0191296 A1 | 8/2007 | Golz et al. |
| 2007/0207974 A1 | 9/2007 | Khvorova et al. |
| 2007/0253949 A1 | 11/2007 | Golz et al. |
| 2007/0287831 A1 | 12/2007 | Seth et al. |
| 2008/0039618 A1 | 2/2008 | Allerson et al. |
| 2008/0113351 A1 | 5/2008 | Naito et al. |
| 2008/0188409 A1 | 8/2008 | Blair et al. |
| 2008/0221031 A1 | 9/2008 | Blair et al. |
| 2008/0280811 A1 | 11/2008 | Feener et al. |
| 2009/0012281 A1 | 1/2009 | Swayze et al. |
| 2009/0067647 A1 | 3/2009 | Yoshizawa et al. |
| 2009/0075887 A1 | 3/2009 | McPherson |
| 2009/0100320 A1 | 4/2009 | Higgs et al. |
| 2009/0105142 A1 | 4/2009 | Moscicki |
| 2009/0221480 A1 | 9/2009 | Blair et al. |
| 2009/0227494 A1 | 9/2009 | Blair et al. |
| 2009/0227495 A1 | 9/2009 | Blair et al. |
| 2009/0233852 A1 | 9/2009 | Blair et al. |
| 2009/0234009 A1 | 9/2009 | Blair et al. |
| 2009/0247453 A1 | 10/2009 | Blair et al. |
| 2009/0264350 A1 | 10/2009 | Blair et al. |
| 2010/0029003 A1 | 2/2010 | Bartel et al. |
| 2010/0093085 A1 | 4/2010 | Yamada et al. |
| 2010/0183625 A1 | 7/2010 | Sternlicht |
| 2011/0200611 A1 | 8/2011 | Sexton |
| 2011/0301215 A1 | 12/2011 | Sinha et al. |
| 2012/0052487 A9 | 3/2012 | Khvorova et al. |
| 2012/0264692 A1 | 10/2012 | Bare et al. |
| 2017/0002359 A1* | 1/2017 | Freier ............... C07H 21/04 |

FOREIGN PATENT DOCUMENTS

| | | |
|---|---|---|
| WO | WO 1998/003665 | 1/1998 |
| WO | WO 1998/039352 | 9/1998 |
| WO | WO 1999/014226 | 3/1999 |
| WO | WO 2001/049687 | 7/2001 |
| WO | WO 2003/004602 | 1/2003 |
| WO | WO 2003/103475 | 12/2003 |
| WO | WO 2004/045527 | 6/2004 |
| WO | WO 2004/106356 | 12/2004 |
| WO | WO 2005/021570 | 3/2005 |
| WO | WO 2005/075665 | 8/2005 |
| WO | WO 2005/083110 | 9/2005 |
| WO | WO 2005/121371 | 12/2005 |
| WO | WO 2006/008002 | 1/2006 |
| WO | WO 2006/036860 | 4/2006 |
| WO | WO 2006/047842 | 5/2006 |
| WO | WO 2007/134181 | 11/2007 |
| WO | WO 2008/016883 | 2/2008 |
| WO | WO 2008/101157 | 8/2008 |
| WO | WO 2008/150729 | 12/2008 |
| WO | WO 2008/154401 | 12/2008 |
| WO | WO 2009/006478 | 1/2009 |
| WO | WO 2009/067647 | 5/2009 |
| WO | WO 2010/036696 | 4/2010 |
| WO | WO 2010/036698 | 4/2010 |
| WO | WO 2011/017521 | 2/2011 |
| WO | WO 2011/075684 | 6/2011 |
| WO | WO 2012/170945 | 12/2012 |
| WO | WO 2012/170947 | 12/2012 |
| WO | WO 2013/003808 | 1/2013 |
| WO | WO 2013/033230 | 3/2013 |
| WO | WO 2014/076195 | 5/2014 |
| WO | WO 2014/179620 | 11/2014 |
| WO | WO 2015/031679 | 3/2015 |
| WO | WO 2015/168532 | 11/2015 |

OTHER PUBLICATIONS

Altschul et al., "Basic Local Alignment Search Tool" J. Mol. Biol. (1990) 215: 403-410.

Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272(18): 11944-12000.

Bhattacharjee et al., "Inhibition of Vascular Permeability by Antisense-Mediated Inhibition of Plasma Kallikrein and Coagulation Factor 12" Nucleic Acid Therapeutics (2013) 23(3): 175-187.

Braasch et al., "Novel Antisense and Peptide Nucleic Acid Strategies for Controlling Gene Expression" Biochemistry (2002) 41(14): 4503-4510.

Braasch et al., "Locked nucleic acid (LNA): fine-tuning the recognition of DNA and RNA" Chem. Biol. (2001) 8:1-7.

Branch et al., "A good antisense molecule is hard to find," TIBS (1998) 23:45-50.

Chao et al., "Novel roles of kallistatin, a specific tissue kallikrein inhibitor, in vascular remodeling." Biol Chem (2001) 382(1): 15-21.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Cichon et al., "Increased activity of coagulation factor XII (Hageman factor) causes hereditary angioedema type III." Am. J. Hum. Genet. (2006) 79: 1098-1104.

Crooke et al., "Basic Principles of Antisense Therapeutics" Antisense Research and Application (1998) Chapter 1:1-50.

Cruden et al., "Therapeutic Potential of Icatibant (HOE-140, JE-049)" Expert Opinion on Pharmacotherapy (2008) 9: 2383-90.

Cruz-Silva et al., "A proteinase inhibitor from Caesalpinia echinata (pau-brasil) seeds for plasma kallikrein, plasmin and factor XIIa." Biol Chem (2004) 385(11): 1083-1086.

Dias et al. "Antisense Oligonucleotides: Basic Concepts and Mechanisms" mol Caner Ther (2002) 1:347-355.

Dowd, "Concomitant antiplatelet and anticoagulation therapy: Indications, controversies and practical advice" Plenary Sessions/Thrombosis Research (2008) 123, Supplement 1: S11-S15.

Evans et al., "Selective inhibitors of plasma kallikrein" Immunopharmacology (1996) 32(1-3): 115-116.

Freier et al., "The ups and downs of nucleic acid duplex stability: structure-stability studies on chemically-modified DNA:RNA duplexes" Nucleic Acids Research (1997) 25(22):4429-4443.

Frieden et al., "Expanding the design horizon of antisense oligonucleotides with alpha-L-LNA" Nucleic Acids Research (2003) 31(21):6365-6372.

Gallo et al., "Design and Applications of Modified Oligonucleotides" Braz J Med Biol Res. (2003) 36:143-151.

Gautschi et al., "Activity of a Novel bcl-2/bcl-xL-Bispecific Antisense Oligonucleotide Against Tumors of Diverse Histologic Origins" J. Natl. Cancer Inst. (2001) 93(6):463-471.

Gigli et al., "Interaction of plasma kallikrein with the C1 inhibitor." J. Immunol. (1970) 104:574-581.

(56) References Cited

OTHER PUBLICATIONS

Gonzalez et al., "Purification and preliminary characterization of a plasma kallikrein inhibitor isolated from sea hares Aplysia dactylomela Rang, 1828" Toxicon (2004) 43(2): 219-223.
Gu et al., "Base Pairing Properties of D- and L-Cyclohexene Nucleic Acids (CeNA)" Oligonucleotides (2003) 13(6): 479-489.
Gu et al., "Synthesis of enantiomeric-pure cyclohexenyl nucleoside building blocks for oligonucleotide synthesis" Tetrahedron (2004) 60(9): 2111-2123.
Gu et al., "Enzymatic resolution and base pairing properties of D- and L-cyclohexenyl nucleic acids (CeNA)." Nucleosides, Nucleotides & Nucleic Acids (2005) 24(5-7): 993-998.
Han et al., "Increased vascular permeability in C1 inhibitor-deficient mice mediated by the bradykinin type 2 receptor." J. Clin. Invest. (2002) 109: 1057-1063.
Horvath et al., "Stereoselective synthesis of (-)-ara-cyclohexenyl-adenine" Tetrahedron Letters (2007) 48: 3621-3623.
Ikarugi et al., "Synergistic antithrombotic effect of a combination of NO donor and plasma kallikrein inhibitor." Thromb Res (2005) 116: 403-408.
Jones et al., "RNA Quantitation by Fluorescence-Based Solution Assay: RiboGreen Reagent Characterization," Analytical Biochemistry (1998) 265: 368-374.
Kaplan et al., "Pathways for bradykinin formation and inflammatory disease." J. Allergy Clin. Immunol. (2002) 109(2): 195-209.
Kim et al., "Pretreatment with nafamostat mesilate, a kallikrein inhibitor, to decrease withdrawal response associated with rocuronium." J. Anesth. (2010) 24(4): 549-552.
Koshkin et al., "LNA (Locked Nucleic Acids): Synthesis of the Adenine, Cytosine, Guanine, 5-Methylcytosine, Thymine and Uracil Biocyclonucleo side Monomers, Oligomerisation, and Unprecedented Nucleic Acid Recognition" Tetrahedron (1998) 54:3607-3630.
Kubitza et al., "Rivaroxaban (BAY 59/7939)—an oral, direct Factor Xa inhibitor—has no clinically relevant interaction with naproxen" Br. J. Clin. Pharmacol. (2006) 63(4): 469-476.
Kumar et al., "The First Analogues of LNA (Locked Nucleic Acids): Phosphorothioate-LNA and 2'-Thio-LNA" Bioorg. Med. Chem. Lett. (1998) 8:2219-2222.
Leumann, "DNA Analogues: From Supramolecular Principles to Biological Properties" Bioorganic & Medicinal Chemistry (2002) 10:841-854.
Lubberstedt et al., "HepaRG human hepatic cell line utility as a surrogate for primary human hepatocytes in drug metabolism assessment in vitro" Journal of Pharmacol. Methods (2011) 63: 59-68.
Mackenzie et al., "Plasma prekallikrein levels are positively associated with circulating lipid levels and the metabolic syndrome in children." Appl. Physiol. Nutr. Metab. (2010) 35: 518-525.
Maher et al., "Comparative hybrid arrest by tandem antisense oligodeoxyribonucleotides or oligodeoxyribonucleoside methylphosphonates in a cell-free system" Nuc. Acid. Res. (1988) 16:3341-3358.
Martin, "Ein neuer Zugang zu 2'-O-Alkylribonucleosiden and Eigenschaften eren Oligonucleotide" Helv. Chim. Acta (1995) 78: 486-504.
Morgan "Hereditary Angioedema-Therapies Old and New" New England Journal of Medicine (2010) 363: 581-83.
Nakane et al., "Nafamostat mesilate, a kallikrein inhibitor, prevents pain on injection with propofol." Br. J. Aneaesth. (1998) 81(6): 963-964.
Heinis et al., "Phage-encoded combinatorial chemical libraries based on bicyclic peptides." Nat Chem Biol (2009) 5(7): 502-507.
Nauwelaerts et al., "Structural characterization and biological evaluation of small interfering RNAs containing cyclohexenyl nucleosides." J. Am. Chem. Soc. (2007) 129(30): 9340-9348.
Nauwelaerts et al., "Cyclohexenyl nucleic acids: conformationally flexible oligonucleotides" Nucleic Acids Research (2005) 33(8): 2452-2463.
New England Biolabs 1998/99 Catalog (cover page and pp. 121 and 284).

Orum et al., "Locked nucleic acids: A promising molecular family for gene-function analysis and antisense drug development" Curr. Opinion Mol. Ther. (2001) 3(3):239-243.
Ravindran et al., "Inhibition of plasma kallikrein by C1-inhibitor: role of endothelial cells and the amino-terminal domain of C1-inhibitor." Thromb Haemost (2004) 92: 1277-1283.
Revenko et al., "Selective depletion of plasma prekallikrein or coagulation factor XII inhibits thrombosis in mice without increased risk of bleeding" Blood (2011) 118(19): 5302-5311.
Reynolds et al., "Rational siRNA design for RNA interference" Nature Biotechnology (2004) 22(3):326-330.
Riedl et al., "Response time for ecallantide treatment of acute hereditary angioedema attacks." Ann Allergy Asthma Immunol (2010) 105(6): 430-436.e2.
Robeyns et al., "Oligonucleotides with cyclohexene-nucleoside building blocks: crystallization and preliminary X-ray studies of a left-handed sequence GTGTACAC" Acta Crystallographica, Section F: Structural Biology and Crystallization Communications (2005) F61(6): 585-586.
Robeyns et al., "Structure of the Fully Modified Left-Handed Cyclohexene Nucleic Acid Sequence GTGTACAC" J. Am. Chem. Soc. (2008) 130(6): 1979-1984.
Sanghvi et al., "Heterocyclic Base Modifications in Nucleic Acids and Their Applications in Antisense Oligonucleotides" Antisense Research and Applications (1993) pp. 273-288.
Schneider et al., "Critical role of kallikrein in hereditary angioedema pathogenesis: a clinical trial of escallantide, a novel kallikrein inhibitor" J. Allery Clin. Immunol. (2007) 120(2):416-422.
Scott et al., "Alpha-1-antitrypsin-Pittsburgh. A potent inhibitor of human plasma factor XIa, kallikrein, and factor XIIf." J Clin Invest (1986) 77(2): 631-634.
Sexton et al., "Specific inhibition of tissue kallikrein 1 with a human monoclonal antibody reveals a potential role in airway diseases" Biochem. J. (2009) 422: 383-392.
Singh et al., "LNA (locked nucleic acids): synthesis and high-affinity nucleic acid recognition" Chem. Commun. (1998) 4:455-456.
Singh et al., "Synthesis of 2'-Amino-LNA: A Novel Conformationally Restricted High-Affinity Oligonucleotide Analogue with a Handle" J. Org. Chem. (1998) 63:10035-10039.
Srivastava et al., "Five- and Six-Membered Conformationally Locked 2',4'-Carbocyclic ribo-Thymidines: Synthesis, Structure, and Biochemical Studies" J. Am. Che,. Soc. (2007) 129:8362-8379.
Stolz et al., "Ecallantide: a plasma kallikrein inhibitor for the treatment of acute attacks of hereditary angioedema." Drugs Today (2010) 46(8): 547-555.
Stoop et al., "Analysis of an engineered plasma kallikrein inhibitor and its effect on contact activation" Biol Chem 2010; 391(4): 425-433.
Verbeure et al., "RNase H mediated cleavage of RNA by cyclohexene nucleic acid (CeNA)" Nucleic Acids Research (2001) 29(24): 4941-4947.
Wahlestedt et al., "Potent and nontoxic antisense oligonucleotides containing locked nucleic acids" PNAS (2000) 97(10):5633-5638.
Wang et al., "Cyclohexene Nucleic Acids (CeNA): Serum Stable Oligonucleotides that Activate RNase H and Increase Duplex Stability with Complementary RNA" J. Am. Chem. (2000) 122: 8595-8602.
Wang et al., "A Straightforward Stereoselective Synthesis of D- and L-5-Hydroxy-4-hydroxymethyl-2-cyclohexenylguanine" J. Org. Chem. (2001) 66: 8478-8482.
Wang et al., "Stereocontrolled Synthesis of Ara-Type Cyclohexenyl Nucleosides" J. Org. Chem. (2003) 68: 4499-4505.
Wang et al., "Cyclohexene nucleic acids (CeNA) form stable duplexes with RNA and induce RNase H activity." Nucleosides, Nucleotides & Nucleic Acids (2001) 20(4-7), 785-788.
Wolf et al., "A synthetic tissue kallikrein inhibitor suppresses cancer cell invasiveness." Am J Pathol (2001) 159: 1797-1805.
Wong et al. "Arterial antithrombotic and bleeding time effects of apixaban, a direct factor Xa inhibitor, in combination with antiplatelet therapy in rabbits" Journal of Thrombosis and Haemostasis (2008) 6: 1736-1741.

(56) References Cited

OTHER PUBLICATIONS

Woolf et al., "Specificity of antisense oligonucleotides in vivo" PNAS (1992) 89:7305-7309.

Wulf et al., "CU-2010—A Novel Small Molecule Protease Inhibitor with Antifibrinolytic and Anticoagulant Properties" Anesthesiology (2009) 110(1): 123-130.

Xu et al., "Effective small interfering RNAs and phosphorothioate antisense DNAs have different preferences for target site in the luciferase mRNAs," Biochemical and Biophysical Research Communications (2003) 306: 712-717.

Zhang e al., "PowerBLAST: A New Network BLAST Application for Interactive or Automate Sequence Analysis and Annoation", Genome Res. (1997) 7: 649-656.

Zhou et al., "Fine Tuning of Electrostatics around the Internucleoside Phosphate through Incorporation of Modified 2',4'-Carbocylic-LNAs and -ENAs Leads to Significant Modulation of Antisense Properties" J. Org. Chem. (2009) 74: 118-134.

Zhou et al., "Kallistatin: a novel human tissue kallikrein inhibitor. Purification, characterization, and reactive center sequence." J. Biol. Chem. (1992) 267(36): 25873-25880.

Zuraw, "Hereditary Angioedema" N. Engl. J. Med. (2008) 359: 1027-36.

European Search Report for application EP 12804096.1 dated Dec. 15, 2014.

European Search Report for application EP 12796547.3 dated Nov. 14, 2014.

International Search Report for application PCT/US12/45105 dated Sep. 25, 2012.

International Search Report for application PCT/US12/41743 dated Nov. 20, 2012.

International Search Report for application PCT/US15/28765 dated Jan. 27, 2016.

International Search Report for application PCT/US14/053266 dated Feb. 25, 2015.

Extended search report for 15786489.3 dated Nov. 27, 2017.

Rajeev, "Conjugation Strategies for In Vitro siRNA Delivery" 8th Annual Meeting of the Oligonucleotide Therapeutics Society (2012).

Sundby, USPTO's Biotechnology/Chemical/Pharmaceutical Customer Partnership Meeting, Biotech Buzz—USPTO Relations Subcommittee, AIPLA, Sep. 14, 2015, 4 pages.

Wilson, "Reviewing Common Themes in Double Patenting," USPTO, Sep. 14, 2015, 33 pages.

\* cited by examiner

COMPOSITIONS AND METHODS FOR MODULATING PKK EXPRESSION

SEQUENCE LISTING

The present application is being filed along with a Sequence Listing in electronic format. The Sequence Listing is provided as a file entitled BIOL0252USASEQ_ST25.txt created Oct. 26, 2016, which is approximately 636 KB in size. The information in the electronic format of the sequence listing is incorporated herein by reference in its entirety.

FIELD

Provided are compounds, compositions, and methods for reducing expression of human plasma prekallikrein (PKK) mRNA and protein in an animal. Such compositions and methods are useful to treat, prevent, or ameliorate inflammatory and thromboembolic conditions.

BACKGROUND

Plasma prekallikrein (PKK) is the precursor of plasma kallikrein (PK), which is encoded by the KLKB1 gene. PKK is a glycoprotein that participates in the surface-dependent activation of blood coagulation, fibrinolysis, kinin generation, and inflammation. PKK is converted to PK by Factor XIIa by the cleavage of an internal Arg-Ile peptide bond. PK liberates kinins from kininogens and also generates plasmin from plasminogen. PK is a member of the kinin-kallikrein pathway, which consists of several proteins that play a role in inflammation, blood pressure control, coagulation, and pain.

SUMMARY

Provided herein are compounds, compositions, and methods for modulating expression of PKK mRNA and protein. In certain embodiments, compounds useful for modulating expression of PKK mRNA and protein are antisense compounds. In certain embodiments, the antisense compounds are antisense oligonucleotides.

In certain embodiments, modulation can occur in a cell or tissue. In certain embodiments, the cell or tissue is in an animal. In certain embodiments, the animal is a human. In certain embodiments, PKK mRNA levels are reduced. In certain embodiments, PKK protein levels are reduced. Such reduction can occur in a time-dependent manner or in a dose-dependent manner.

Also provided are compounds, compositions, and methods useful for preventing, treating, and ameliorating diseases, disorders, and conditions associated with PKK. In certain embodiments, such PKK associated diseases, disorders, and conditions are inflammatory diseases. In certain embodiments, the inflammatory disease may be an acute or chronic inflammatory disease. In certain embodiments, such inflammatory diseases may include hereditary angioedema (HAE), edema, angioedema, swelling, angioedema of the lids, ocular edema, macular edema, and cerebral edema. In certain embodiments, such PKK associated diseases, disorders, and conditions are thromboembolic diseases. In certain embodiments, such thromboembolic diseases may include thrombosis, embolism, thromboembolism, deep vein thrombosis, pulmonary embolism, myocardial infarction, stroke, and infarct.

Such diseases, disorders, and conditions can have one or more risk factors, causes, or outcomes in common.

Certain risk factors and causes for development of an inflammatory disease include genetic predisposition to an inflammatory disease and environmental factors. In certain embodiments, the subject has a mutated complement 1 esterase inhibitor (C1-INH) gene or mutated Factor 12 gene. In certain embodiments, the subject has taken or is on angiotensin-converting enzyme inhibitors (ACE inhibitors) or angiotensin II receptor blockers (ARBs). In certain embodiments, the subject has had an allergic reaction leading to angioedema. In certain embodiments, the subject has type I HAE. In certain embodiments, the subject has type II HAE. In certain embodiments, the subject has type III HAE.

Certain outcomes associated with development of an inflammatory disease include edema/swelling in various body parts including the extremities (i.e., hands, feet, arms, legs), the intestines (abdomen), the face, the genitals, the larynx (i.e., voice box); vascular permeability; vascular leakage; generalized inflammation; abdominal pain; bloating; vomiting; diarrhea; itchy skin; respiratory (asthmatic) reactions; rhinitis; anaphylaxis; bronchoconstriction; hypotension; coma; and death.

Certain risk factors and causes for development of a thromboembolic disease include genetic predisposition to a thromboembolic disease, immobility, surgery (particularly orthopedic surgery), malignancy, pregnancy, older age, use of oral contraceptives, atrial fibrillation, previous thromboembolic condition, chronic inflammatory disease, and inherited or acquired prothrombotic clotting disorders. Certain outcomes associated with development of a thromboembolic condition include decreased blood flow through an affected vessel, death of tissue, and death.

In certain embodiments, methods of treatment include administering a PKK antisense compound to an individual in need thereof. In certain embodiments, methods of treatment include administering a PKK antisense oligonucleotide to an individual in need thereof.

DETAILED DESCRIPTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

Unless specific definitions are provided, the nomenclature used in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Certain such techniques and procedures may be found for example in "Carbohydrate Modifications in Antisense Research" Edited by Sangvi and Cook, American Chemical Society, Washington D.C., 1994; "Remington's Pharmaceutical Sciences," Mack Publishing Co., Easton, Pa., 21$^{st}$ edition, 2005; and "Antisense Drug Technology, Principles, Strategies, and Applications" Edited by Stanley T. Crooke, CRC Press, Boca Raton, Fla.; and Sambrook et al., "Molecular Cloning, A laboratory Manual," 2$^{nd}$ Edition, Cold Spring Harbor Laboratory Press, 1989, which are hereby incorporated by reference for any purpose. Where permitted, all patents, applications, published applications and other publications and other data referred to throughout in the disclosure are incorporated by reference herein in their entirety.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference for the portions of the document discussed herein, as well as in their entirety.

Definitions

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference for the portions of the document discussed herein, as well as in their entirety.

Unless otherwise indicated, the following terms have the following meanings:

"2'-O-methoxyethyl" (also 2'-MOE and 2'-OCH$_2$CH$_2$—OCH$_3$ and MOE) refers to an O-methoxyethyl modification of the 2' position of a furanose ring. A 2'-O-methoxyethyl modified sugar is a modified sugar.

"2'-O-methoxyethyl modified nucleoside" (also "2'-MOE nucleoside") means a nucleoside comprising a 2'-MOE modified sugar moiety.

"2'-substituted nucleoside" means a nucleoside comprising a substituent at the 2'-position of the furanose ring other than H or OH. In certain embodiments, 2' substituted nucleosides include nucleosides with bicyclic sugar modifications.

"2'-deoxynucleoside" means a nucleoside comprising a hydrogen at the 2' position of the sugar portion of the nucleoside.

"3' target site" refers to the nucleotide of a target nucleic acid which is complementary to the 3'-most nucleotide of a particular antisense compound.

"5' target site" refers to the nucleotide of a target nucleic acid which is complementary to the 5'-most nucleotide of a particular antisense compound.

"5-methylcytosine" means a cytosine modified with a methyl group attached to the 5 position. A 5-methylcytosine is a modified nucleobase.

"About" means within ±7% of a value. For example, if it is stated, "the compounds affected at least about 70% inhibition of PKK", it is implied that the PKK levels are inhibited within a range of 63% and 77%.

"Administered concomitantly" refers to the co-administration of two pharmaceutical agents in any manner in which the pharmacological effects of both are manifest in the patient at the same time. Concomitant administration does not require that both pharmaceutical agents be administered in a single pharmaceutical composition, in the same dosage form, or by the same route of administration. The effects of both pharmaceutical agents need not manifest themselves at the same time. The effects need only be overlapping for a period of time and need not be coextensive.

"Administering" means providing a pharmaceutical agent to an animal, and includes, but is not limited to administering by a medical professional and self-administering.

"Alkyl," as used herein, means a saturated straight or branched hydrocarbon radical containing up to twenty four carbon atoms. Examples of alkyl groups include without limitation, methyl, ethyl, propyl, butyl, isopropyl, n-hexyl, octyl, decyl, dodecyl and the like. Alkyl groups typically include from 1 to about 24 carbon atoms, more typically from 1 to about 12 carbon atoms (C$_1$-C$_{12}$ alkyl) with from 1 to about 6 carbon atoms being more preferred.

As used herein, "alkenyl," means a straight or branched hydrocarbon chain radical containing up to twenty four carbon atoms and having at least one carbon-carbon double bond. Examples of alkenyl groups include without limitation, ethenyl, propenyl, butenyl, 1-methyl-2-buten-1-yl, dienes such as 1,3-butadiene and the like. Alkenyl groups typically include from 2 to about 24 carbon atoms, more typically from 2 to about 12 carbon atoms with from 2 to about 6 carbon atoms being more preferred. Alkenyl groups as used herein may optionally include one or more further substituent groups.

As used herein, "alkynyl," means a straight or branched hydrocarbon radical containing up to twenty four carbon atoms and having at least one carbon-carbon triple bond. Examples of alkynyl groups include, without limitation, ethynyl, 1-propynyl, 1-butynyl, and the like. Alkynyl groups typically include from 2 to about 24 carbon atoms, more typically from 2 to about 12 carbon atoms with from 2 to about 6 carbon atoms being more preferred. Alkynyl groups as used herein may optionally include one or more further substituent groups.

As used herein, "acyl," means a radical formed by removal of a hydroxyl group from an organic acid and has the general Formula —C(O)—X where X is typically aliphatic, alicyclic or aromatic. Examples include aliphatic carbonyls, aromatic carbonyls, aliphatic sulfonyls, aromatic sulfinyls, aliphatic sulfinyls, aromatic phosphates, aliphatic phosphates and the like. Acyl groups as used herein may optionally include further substituent groups.

As used herein, "alicyclic" means a cyclic ring system wherein the ring is aliphatic. The ring system can comprise one or more rings wherein at least one ring is aliphatic. Preferred alicyclics include rings having from about 5 to about 9 carbon atoms in the ring. Alicyclic as used herein may optionally include further substituent groups.

As used herein, "aliphatic" means a straight or branched hydrocarbon radical containing up to twenty four carbon atoms wherein the saturation between any two carbon atoms is a single, double or triple bond. An aliphatic group preferably contains from 1 to about 24 carbon atoms, more typically from 1 to about 12 carbon atoms with from 1 to about 6 carbon atoms being more preferred. The straight or branched chain of an aliphatic group may be interrupted with one or more heteroatoms that include nitrogen, oxygen, sulfur and phosphorus. Such aliphatic groups interrupted by heteroatoms include without limitation, polyalkoxys, such as polyalkylene glycols, polyamines, and polyimines. Aliphatic groups as used herein may optionally include further substituent groups.

As used herein, "alkoxy" means a radical formed between an alkyl group and an oxygen atom wherein the oxygen atom is used to attach the alkoxy group to a parent molecule. Examples of alkoxy groups include without limitation, methoxy, ethoxy, propoxy, isopropoxy, n-butoxy, sec-butoxy, tert-butoxy, n-pentoxy, neopentoxy, n-hexoxy and the like. Alkoxy groups as used herein may optionally include further substituent groups.

As used herein, "aminoalkyl" means an amino substituted $C_1$-$C_{12}$ alkyl radical. The alkyl portion of the radical forms a covalent bond with a parent molecule. The amino group can be located at any position and the aminoalkyl group can be substituted with a further substituent group at the alkyl and/or amino portions.

As used herein, "aralkyl" and "arylalkyl" mean an aromatic group that is covalently linked to a $C_1$-$C_{12}$ alkyl radical. The alkyl radical portion of the resulting aralkyl (or arylalkyl) group forms a covalent bond with a parent molecule. Examples include without limitation, benzyl, phenethyl and the like. Aralkyl groups as used herein may optionally include further substituent groups attached to the alkyl, the aryl or both groups that form the radical group.

As used herein, "aryl" and "aromatic" mean a mono- or polycyclic carbocyclic ring system radicals having one or more aromatic rings. Examples of aryl groups include without limitation, phenyl, naphthyl, tetrahydronaphthyl, indanyl, idenyl and the like. Preferred aryl ring systems have from about 5 to about 20 carbon atoms in one or more rings. Aryl groups as used herein may optionally include further substituent groups.

"Amelioration" refers to a lessening, slowing, stopping, or reversing of at least one indicator of the severity of a condition or disease. The severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid. "Antisense compound" means an oligomeric compound that is capable of undergoing hybridization to a target nucleic acid through hydrogen bonding. Examples of antisense compounds include single-stranded and double-stranded compounds, such as, antisense oligonucleotides, siRNAs, shRNAs, ssRNAs, and occupancy-based compounds.

"Antisense compound" means an oligomeric compound that is capable of undergoing hybridization to a target nucleic acid through hydrogen bonding. Examples of antisense compounds include single-stranded and double-stranded compounds, such as, antisense oligonucleotides, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels or in the absence of the antisense compound. "Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense mechanisms" are all those mechanisms involving hybridization of a compound with a target nucleic acid, wherein the outcome or effect of the hybridization is either target degradation or target occupancy with concomitant stalling of the cellular machinery involving, for example, transcription or splicing.

"Antisense oligonucleotide" means a single-stranded oligonucleotide having a nucleobase sequence that permits hybridization to a corresponding segment of a target nucleic acid. "Base complementarity" refers to the capacity for the precise base pairing of nucleobases of an antisense oligonucleotide with corresponding nucleobases in a target nucleic acid (i.e., hybridization), and is mediated by Watson-Crick, Hoogsteen or reversed Hoogsteen hydrogen binding between corresponding nucleobases.

"Base complementarity" refers to the capacity for the precise base pairing of nucleobases of an antisense oligonucleotide with corresponding nucleobases in a target nucleic acid (i.e., hybridization), and is mediated by Watson-Crick, Hoogsteen or reversed Hoogsteen hydrogen binding between corresponding nucleobases.

"Bicyclic sugar" means a furanose ring modified by the bridging of two atoms. A bicyclic sugar is a modified sugar.

"Bicyclic nucleoside" (also BNA) means a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring.

"Cap structure" or "terminal cap moiety" means chemical modifications, which have been incorporated at either terminus of an antisense compound.

"Carbohydrate" means a naturally occurring carbohydrate, a modified carbohydrate, or a carbohydrate derivative.

"Carbohydrate cluster" means a compound having one or more carbohydrate residues attached to a scaffold or linker group. (see, e.g., Maier et al., "Synthesis of Antisense Oligonucleotides Conjugated to a Multivalent Carbohydrate Cluster for Cellular Targeting," *Bioconjugate Chemistry*, 2003, (14): 18-29, which is incorporated herein by reference in its entirety, or Rensen et al., "Design and Synthesis of Novel N-Acetylgalactosamine-Terminated Glycolipids for Targeting of Lipoproteins to the Hepatic Asiaglycoprotein Receptor," *J. Med. Chem.* 2004, (47): 5798-5808, for examples of carbohydrate conjugate clusters).

"Carbohydrate derivative" means any compound which may be synthesized using a carbohydrate as a starting material or intermediate.

"cEt" or "constrained ethyl" means a bicyclic nucleoside having a sugar moiety comprising a bridge connecting the 4'-carbon and the 2'-carbon, wherein the bridge has the formula: 4'-CH($CH_3$)—O-2'.

"cEt modified nucleoside" (also "constrained ethyl nucleoside") means a nucleoside comprising a bicyclic sugar moiety comprising a 4'-CH($CH_3$)—O-2' bridge.

"Chemically distinct region" refers to a region of an antisense compound that is in some way chemically different than another region of the same antisense compound. For example, a region having 2'-O-methoxyethyl nucleosides is chemically distinct from a region having nucleosides without 2'-O-methoxyethyl modifications.

"Chemical modification" means a chemical difference in a compound when compared to a naturally occurring counterpart. Chemical modifications of oligonucleotides include nucleoside modifications (including sugar moiety modifications and nucleobase modifications) and internucleoside linkage modifications. In reference to an oligonucleotide, chemical modification does not include differences only in nucleobase sequence.

"Chimeric antisense compound" means an antisense compound that has at least two chemically distinct regions, each position having a plurality of subunits.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group that is capable of being split under physiological conditions. In certain embodiments, a cleavable moiety is cleaved inside a cell or sub-cellular compartments, such as a lysosome. In certain embodiments, a cleavable moiety is cleaved by endogenous enzymes, such as nucleases. In certain embodiments, a cleavable moiety comprises a group of atoms having one, two, three, four, or more than four cleavable bonds.

"Co-administration" means administration of two or more pharmaceutical agents to an individual. The two or more pharmaceutical agents may be in a single pharmaceutical composition, or may be in separate pharmaceutical compositions. Each of the two or more pharmaceutical agents may be administered through the same or different routes of administration. Co-administration encompasses parallel or sequential administration.

"Complementarity" means the capacity for pairing between nucleobases of a first nucleic acid and a second nucleic acid.

"Comprise," "comprises," and "comprising" will be understood to imply the inclusion of a stated step or element or group of steps or elements but not the exclusion of any other step or element or group of steps or elements. p "Conjugate" or "conjugate group" means an atom or group of atoms bound to an oligonucleotide or oligomeric compound. In general, conjugate groups modify one or more properties of the compound to which they are attached, including, but not limited to pharmacodynamic, pharmacokinetic, binding, absorption, cellular distribution, cellular uptake, charge and/or clearance properties.

"conjugate linker" or "linker" in the context of a conjugate group means a portion of a conjugate group comprising any atom or group of atoms and which covalently link (1) an oligonucleotide to another portion of the conjugate group or (2) two or more portions of the conjugate group.

Conjugate groups are shown herein as radicals, providing a bond for forming covalent attachment to an oligomeric compound such as an antisense oligonucleotide. In certain embodiments, the point of attachment on the oligomeric compound is the 3'-oxygen atom of the 3'-hydroxyl group of the 3' terminal nucleoside of the oligomeric compound. In certain embodiments the point of attachment on the oligomeric compound is the 5'-oxygen atom of the 5'-hydroxyl group of the 5' terminal nucleoside of the oligomeric compound. In certain embodiments, the bond for forming attachment to the oligomeric compound is a cleavable bond. In certain such embodiments, such cleavable bond constitutes all or part of a cleavable moiety.

In certain embodiments, conjugate groups comprise a cleavable moiety (e.g., a cleavable bond or cleavable nucleoside) and a carbohydrate cluster portion, such as a GalNAc cluster portion. Such carbohydrate cluster portion comprises: a targeting moiety and, optionally, a conjugate linker. In certain embodiments, the carbohydrate cluster portion is identified by the number and identity of the ligand. For example, in certain embodiments, the carbohydrate cluster portion comprises 3 GalNAc groups and is designated "GalNAc$_3$". In certain embodiments, the carbohydrate cluster portion comprises 4 GalNAc groups and is designated "GalNAc$_4$". Specific carbohydrate cluster portions (having specific tether, branching and conjugate linker groups) are described herein and designated by Roman numeral followed by subscript "a". Accordingly "GalNac3-1$_a$" refers to a specific carbohydrate cluster portion of a conjugate group having 3 GalNac groups and specifically identified tether, branching and linking groups. Such carbohydrate cluster fragment is attached to an oligomeric compound via a cleavable moiety, such as a cleavable bond or cleavable nucleoside.

"Conjugate compound" means any atoms, group of atoms, or group of linked atoms suitable for use as a conjugate group. In certain embodiments, conjugate compounds may possess or impart one or more properties, including, but not limited to pharmacodynamic, pharmacokinetic, binding, absorption, cellular distribution, cellular uptake, charge and/or clearance properties.

"Contiguous nucleobases" means nucleobases immediately adjacent to each other.

"Designing" or "Designed to" refer to the process of creating an oligomeric compound that specifically hybridizes with a selected nucleic acid molecule.

"Diluent" means an ingredient in a composition that lacks pharmacological activity, but is pharmaceutically necessary or desirable. For example, in drugs that are injected, the diluent may be a liquid, e.g. saline solution.

"Dose" means a specified quantity of a pharmaceutical agent provided in a single administration, or in a specified time period. In certain embodiments, a dose may be administered in one, two, or more boluses, tablets, or injections. For example, in certain embodiments where subcutaneous administration is desired, the desired dose requires a volume not easily accommodated by a single injection, therefore, two or more injections may be used to achieve the desired dose. In certain embodiments, the pharmaceutical agent is administered by infusion over an extended period of time or continuously. Doses may be stated as the amount of pharmaceutical agent per hour, day, week, or month.

"Downstream" refers to the relative direction toward the 3' end or C-terminal end of a nucleic acid.

"Effective amount" in the context of modulating an activity or of treating or preventing a condition means the administration of that amount of pharmaceutical agent to a subject in need of such modulation, treatment, or prophylaxis, either in a single dose or as part of a series, that is effective for modulation of that effect, or for treatment or prophylaxis or improvement of that condition. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to the products of transcription and translation.

"Fully complementary" or "100% complementary" means each nucleobase of a first nucleic acid has a complementary nucleobase in a second nucleic acid. In certain embodiments, a first nucleic acid is an antisense compound and a target nucleic acid is a second nucleic acid.

"Gapmer" means a chimeric antisense compound in which an internal region having a plurality of nucleosides that support RNase H cleavage is positioned between external regions having one or more nucleosides, wherein the nucleosides comprising the internal region are chemically distinct from the nucleoside or nucleosides comprising the external regions. The internal region may be referred to as a "gap" and the external regions may be referred to as the "wings."

"Halo" and "halogen," mean an atom selected from fluorine, chlorine, bromine and iodine.

"Heteroaryl," and "heteroaromatic," mean a radical comprising a mono- or poly-cyclic aromatic ring, ring system or fused ring system wherein at least one of the rings is aromatic and includes one or more heteroatoms. Heteroaryl is also meant to include fused ring systems including systems where one or more of the fused rings contain no heteroatoms. Heteroaryl groups typically include one ring atom selected from sulfur, nitrogen or oxygen. Examples of heteroaryl groups include without limitation, pyridinyl, pyrazinyl, pyrimidinyl, pyrrolyl, pyrazolyl, imidazolyl, thiazolyl, oxazolyl, isooxazolyl, thiadiazolyl, oxadiazolyl, thiophenyl, furanyl, quinolinyl, isoquinolinyl, benzimidazolyl, benzooxazolyl, quinoxalinyl and the like. Heteroaryl radicals can be attached to a parent molecule directly or through a linking moiety such as an aliphatic group or hetero atom. Heteroaryl groups as used herein may optionally include further substituent groups.

"Hybridization" means the annealing of complementary nucleic acid molecules. In certain embodiments, complementary nucleic acid molecules include, but are not limited to, an antisense compound and a target nucleic acid. In certain embodiments, complementary nucleic acid molecules include, but are not limited to, an antisense oligonucleotide and a nucleic acid target.

"Identifying an animal having an inflammatory disease" means identifying an animal having been diagnosed with an inflammatory disease or predisposed to develop an inflammatory disease. Individuals predisposed to develop an inflammatory disease include those having one or more risk factors for developing an inflammatory disease including environmental factors, having a personal or family history, or genetic predisposition to one or more inflammatory disease. Such identification may be accomplished by any method including evaluating an individual's medical history and standard clinical tests or assessments, such as genetic testing.

"Identifying an animal having a PKK associated disease" means identifying an animal having been diagnosed with a PKK associated disease or predisposed to develop a PKK associated disease. Individuals predisposed to develop a PKK associated disease include those having one or more risk factors for developing a PKK associated disease including having a personal or family history, or genetic predisposition of one or more PKK associated diseases. Such identification may be accomplished by any method including evaluating an individual's medical history and standard clinical tests or assessments, such as genetic testing.

"Identifying an animal having a thromboembolic disease" means identifying an animal having been diagnosed with a thromboembolic disease or predisposed to develop a thromboembolic disease. Individuals predisposed to develop a thromboembolic disease include those having one or more risk factors for developing a thromboembolic disease including having a personal or family history, or genetic predisposition of one or more thromboembolic diseases, immobility, surgery (particularly orthopedic surgery), malignancy, pregnancy, older age, use of oral contraceptives, atrial fibrillation, previous thromboembolic condition, chronic inflammatory disease, and inherited or acquired prothrombotic clotting disorders. Such identification may be accomplished by any method including evaluating an individual's medical history and standard clinical tests or assessments, such as genetic testing.

"Immediately adjacent" means there are no intervening elements between the immediately adjacent elements. "Individual" means a human or non-human animal selected for treatment or therapy.

"Individual" means a human or non-human animal selected for treatment or therapy.

"Inhibiting PKK" means reducing the level or expression of a PKK mRNA and/or protein. In certain embodiments, PKK mRNA and/or protein levels are inhibited in the presence of an antisense compound targeting PKK, including an antisense oligonucleotide targeting PKK, as compared to expression of PKK mRNA and/or protein levels in the absence of a PKK antisense compound, such as an antisense oligonucleotide.

"Inhibiting the expression or activity" refers to a reduction or blockade of the expression or activity and does not necessarily indicate a total elimination of expression or activity.

"Internucleoside linkage" refers to the chemical bond between nucleosides.

"Internucleoside neutral linking group" means a neutral linking group that directly links two nucleosides.

"Internucleoside phosphorus linking group" means a phosphorus linking group that directly links two nucleosides.

"Linkage motif" means a pattern of linkage modifications in an oligonucleotide or region thereof. The nucleosides of such an oligonucleotide may be modified or unmodified. Unless otherwise indicated, motifs herein describing only linkages are intended to be linkage motifs. Thus, in such instances, the nucleosides are not limited.

"Linked nucleosides" means adjacent nucleosides linked together by an internucleoside linkage.

"Locked nucleic acid" or "LNA" or "LNA nucleosides" means nucleic acid monomers having a bridge connecting two carbon atoms between the 4' and 2' position of the nucleoside sugar unit, thereby forming a bicyclic sugar. Examples of such bicyclic sugar include, but are not limited to A) α-L-Methyleneoxy (4'-$CH_2$—O-2') LNA, (B) β-D-Methyleneoxy (4'-$CH_2$—O-2') LNA, (C) Ethyleneoxy (4'-$(CH_2)_2$—O-2') LNA, (D) Aminooxy (4'-$CH_2$—O—N(R)-2') LNA and (E) Oxyamino (4'-$CH_2$—N(R)—O-2') LNA, as depicted below.

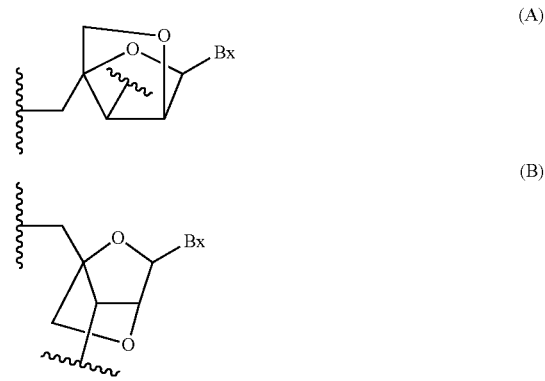

(A)

(B)

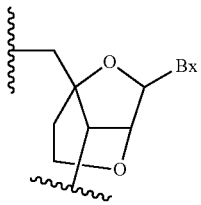
(C)

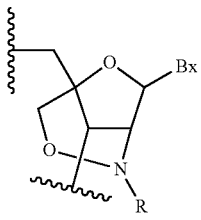
(D)

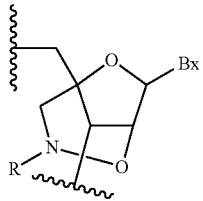
(E)

As used herein, LNA compounds include, but are not limited to, compounds having at least one bridge between the 4' and the 2' position of the sugar wherein each of the bridges independently comprises 1 or from 2 to 4 linked groups independently selected from —[C(R$_1$)(R$_2$)]$_n$—, —C(R$_1$)=C(R$_2$)—, —C(R$_1$)=N—, —C(=NR$_1$)—, —C(=O)—, —C(=S)—, —O—, —Si(R$_1$)$_2$—, —S(=O)$_x$— and —N(R$_1$)—; wherein: x is 0, 1, or 2; n is 1, 2, 3, or 4; each R$_1$ and R$_2$ is, independently, H, a protecting group, hydroxyl, C$_1$-C$_2$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, a heterocycle radical, a substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

Examples of 4'-2' bridging groups encompassed within the definition of LNA include, but are not limited to one of formulae: —[C(R$_1$)(R$_2$)]$_n$—, —[C(R$_1$)(R$_2$)]$_n$—O—, —C(R$_1$R$_2$)—N(R$_1$)—O— or —C(R$_1$R$_2$)—O—N(R$_1$)—. Furthermore, other bridging groups encompassed with the definition of LNA are 4'-CH$_2$-2',4'-(CH$_2$)$_2$-2',4'-(CH$_2$)$_3$-2', 4'-CH$_2$—O-2', 4'-(CH$_2$)$_2$—O-2', 4'-CH$_2$—O—N(R$_1$)-2' and 4'-CH$_2$—N(R$_1$)—O-2'- bridges, wherein each R$_1$ and R$_2$ is, independently, H, a protecting group or C$_1$-C$_{12}$ alkyl.

Also included within the definition of LNA according to the invention are LNAs in which the 2'-hydroxyl group of the ribosyl sugar ring is connected to the 4' carbon atom of the sugar ring, thereby forming a methyleneoxy (4'-CH$_2$—O-2') bridge to form the bicyclic sugar moiety. The bridge can also be a methylene (—CH$_2$—) group connecting the 2' oxygen atom and the 4' carbon atom, for which the term methyleneoxy (4'-CH$_2$—O-2') LNA is used. Furthermore; in the case of the bicyclic sugar moiety having an ethylene bridging group in this position, the term ethyleneoxy (4'-CH$_2$CH$_2$—O-2') LNA is used. α-L-methyleneoxy (4'-CH$_2$—O-2'), an isomer of methyleneoxy (4'-CH$_2$—O-2') LNA is also encompassed within the definition of LNA, as used herein.

"Mismatch" or "non-complementary nucleobase" refers to the case when a nucleobase of a first nucleic acid is not capable of pairing with the corresponding nucleobase of a second or target nucleic acid.

"Modified internucleoside linkage" refers to a substitution or any change from a naturally occurring internucleoside bond (i.e. a phosphodiester internucleoside bond).

"Modified nucleobase" means any nucleobase other than adenine, cytosine, guanine, thymidine (also known as 5-methyluracil), or uracil. An "unmodified nucleobase" means the purine bases adenine (A) and guanine (G), and the pyrimidine bases thymine (T), cytosine (C), and uracil (U).

"Modified nucleoside" means a nucleoside having, independently, a modified sugar moiety and/or modified nucleobase.

"Modified nucleotide" means a nucleotide having, independently, a modified sugar moiety, modified internucleoside linkage, and/or modified nucleobase.

"Modified oligonucleotide" means an oligonucleotide comprising at least one modified internucleoside linkage, modified sugar, and/or modified nucleobase.

"Modified sugar" means substitution and/or any change from a natural sugar moiety.

"Mono or polycyclic ring system" is meant to include all ring systems selected from single or polycyclic radical ring systems wherein the rings are fused or linked and is meant to be inclusive of single and mixed ring systems individually selected from aliphatic, alicyclic, aryl, heteroaryl, aralkyl, arylalkyl, heterocyclic, heteroaryl, heteroaromatic and heteroarylalkyl. Such mono and poly cyclic structures can contain rings that each have the same level of saturation or each, independently, have varying degrees of saturation including fully saturated, partially saturated or fully unsaturated. Each ring can comprise ring atoms selected from C, N, O and S to give rise to heterocyclic rings as well as rings comprising only C ring atoms which can be present in a mixed motif such as for example benzimidazole wherein one ring has only carbon ring atoms and the fused ring has two nitrogen atoms. The mono or polycyclic ring system can be further substituted with substituent groups such as for example phthalimide which has two =O groups attached to one of the rings. Mono or polycyclic ring systems can be attached to parent molecules using various strategies such as directly through a ring atom, fused through multiple ring atoms, through a substituent group or through a bifunctional linking moiety.

"Monomer" means a single unit of an oligomer. Monomers include, but are not limited to, nucleosides and nucleotides, whether naturally occurring or modified.

"Motif" means the pattern of unmodified and modified nucleosides in an antisense compound.

"Natural sugar moiety" means a sugar moiety found in DNA (2'-H) or RNA (2'-OH).

"Naturally occurring internucleoside linkage" means a 3' to 5' phosphodiester linkage.

"Neutral linking group" means a linking group that is not charged. Neutral linking groups include without limitation phosphotriesters, methylphosphonates, MMI (—CH$_2$—N(CH$_3$)—O—), amide-3 (—CH$_2$—C(=O)—N(H)—), amide-4 (—CH₂—N(H)—C(=O)—), formacetal (—O—CH₂—O—), and thioformacetal (—S—CH₂—O—). Further neutral linking groups include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook Eds. ACS Symposium Series 580; Chapters 3 and 4, (pp. 40-65)). Further neutral linking groups include nonionic linkages comprising mixed N, O, S and CH₂ component parts.

"Non-complementary nucleobase" refers to a pair of nucleobases that do not form hydrogen bonds with one another or otherwise support hybridization.

"Non-internucleoside neutral linking group" means a neutral linking group that does not directly link two nucleosides. In certain embodiments, a non-internucleoside neutral linking group links a nucleoside to a group other than a nucleoside. In certain embodiments, a non-internucleoside neutral linking group links two groups, neither of which is a nucleoside.

"Non-internucleoside phosphorus linking group" means a phosphorus linking group that does not directly link two nucleosides. In certain embodiments, a non-internucleoside phosphorus linking group links a nucleoside to a group other than a nucleoside. In certain embodiments, a non-internucleoside phosphorus linking group links two groups, neither of which is a nucleoside.

"Nucleic acid" refers to molecules composed of monomeric nucleotides. A nucleic acid includes, but is not limited to, ribonucleic acids (RNA), deoxyribonucleic acids (DNA), single-stranded nucleic acids, double-stranded nucleic acids, small interfering ribonucleic acids (siRNA), and microRNAs (miRNA).

"Nucleobase" means a heterocyclic moiety capable of pairing with a base of another nucleic acid.

"Nucleobase complementarity" refers to a nucleobase that is capable of base pairing with another nucleobase. For example, in DNA, adenine (A) is complementary to thymine (T). For example, in RNA, adenine (A) is complementary to uracil (U). In certain embodiments, complementary nucleobase refers to a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair.

"Nucleobase modification motif" means a pattern of modifications to nucleobases along an oligonucleotide. Unless otherwise indicated, a nucleobase modification motif is independent of the nucleobase sequence.

"Nucleobase sequence" means the order of contiguous nucleobases independent of any sugar, linkage, and/or nucleobase modification.

"Nucleoside" means a nucleobase linked to a sugar.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo, or tricyclo sugar mimetics, e.g., non furanose sugar units. Nucleotide mimetic includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage). Sugar surrogate overlaps with the slightly broader term nucleoside mimetic but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system. "Mimetic" refers to groups that are substituted for a sugar, a nucleobase, and/or internucleoside linkage. Generally, a mimetic is used in place of the sugar or sugar-internucleoside linkage combination, and the nucleobase is maintained for hybridization to a selected target.

"Nucleoside motif" means a pattern of nucleoside modifications in an oligonucleotide or a region thereof. The linkages of such an oligonucleotide may be modified or unmodified. Unless otherwise indicated, motifs herein describing only nucleosides are intended to be nucleoside motifs. Thus, in such instances, the linkages are not limited.

"Nucleotide" means a nucleoside having a phosphate group covalently linked to the sugar portion of the nucleoside.

"Off-target effect" refers to an unwanted or deleterious biological effect associated with modulation of RNA or protein expression of a gene other than the intended target nucleic acid.

"Oligomeric compound" or "oligomer" means a polymer of linked monomeric subunits which is capable of hybridizing to at least a region of a nucleic acid molecule.

"Oligonucleotide" means a polymer of linked nucleosides each of which can be modified or unmodified, independent one from another.

"Parenteral administration" means administration through injection (e.g., bolus injection) or infusion. Parenteral administration includes subcutaneous administration, intravenous administration, intramuscular administration, intraarterial administration, intraperitoneal administration, or intracranial administration, e.g., intrathecal or intracerebroventricular administration.

"Peptide" means a molecule formed by linking at least two amino acids by amide bonds. Without limitation, as used herein, peptide refers to polypeptides and proteins.

"Pharmaceutical agent" means a substance that provides a therapeutic benefit when administered to an individual. For example, in certain embodiments, an antisense oligonucleotide targeted to PKK is a pharmaceutical agent.

"Pharmaceutical composition" means a mixture of substances suitable for administering to a subject. For example, a pharmaceutical composition may comprise an antisense oligonucleotide and a sterile aqueous solution.

"Pharmaceutically acceptable derivative" encompasses pharmaceutically acceptable salts, conjugates, prodrugs or isomers of the compounds described herein.

"Pharmaceutically acceptable salts" means physiologically and pharmaceutically acceptable salts of antisense compounds, i.e., salts that retain the desired biological activity of the parent oligonucleotide and do not impart undesired toxicological effects thereto.

"Phosphorothioate linkage" means a linkage between nucleosides where the phosphodiester bond is modified by replacing one of the non-bridging oxygen atoms with a sulfur atom. A phosphorothioate linkage is a modified internucleoside linkage.

"Phosphorus linking group" means a linking group comprising a phosphorus atom. Phosphorus linking groups include without limitation groups having the formula:

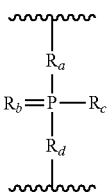

wherein:

$R_a$ and $R_d$ are each, independently, O, S, $CH_2$, NH, or $NJ_1$ wherein $J_1$ is $C_1$-$C_6$ alkyl or substituted $C_1$-$C_6$ alkyl;

$R_b$ is O or S;

$R_c$ is OH, SH, $C_1$-$C_6$ alkyl, substituted $C_1$-$C_6$ alkyl, $C_1$-$C_6$ alkoxy, substituted $C_1$-$C_6$ alkoxy, amino or substituted amino; and $J_1$ is $R_b$ is O or S.

Phosphorus linking groups include without limitation, phosphodiester, phosphorothioate, phosphorodithioate, phosphonate, phosphoramidate, phosphorothioamidate, thionoalkylphosphonate, phosphotriesters, thionoalkylphosphotriester and boranophosphate.

"PKK" means mammalian plasma prekallikrein, including human plasma prekallikrein. Plasma prekallikrein (PKK) is the precursor of plasma kallikrein (PK), which is encoded by the KLKB1 gene.

"PKK associated disease" means any disease associated with any PKK nucleic acid or expression product thereof. Such diseases may include an inflammatory disease or a thromboembolic disease. Such diseases may include hereditary angioedema (HAE).

"PKK mRNA" means any messenger RNA expression product of a DNA sequence encoding PKK.

"PKK nucleic acid" means any nucleic acid encoding PKK. For example, in certain embodiments, a PKK nucleic acid includes a DNA sequence encoding PKK, an RNA sequence transcribed from DNA encoding PKK (including genomic DNA comprising introns and exons), and an mRNA sequence encoding PKK. "PKK mRNA" means an mRNA encoding a PKK protein.

"PKK protein" means the polypeptide expression product of a PKK nucleic acid.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an antisense compound.

"Prevent" or "preventing" refers to delaying or forestalling the onset or development of a disease, disorder, or condition for a period of time from minutes to days, weeks to months, or indefinitely.

"Prodrug" means a therapeutic agent that is prepared in an inactive form that is converted to an active form (i.e., drug) within the body or cells thereof by the action of endogenous enzymes or other chemicals and/or conditions.

"Prophylactically effective amount" refers to an amount of a pharmaceutical agent that provides a prophylactic or preventative benefit to an animal.

"Protecting group" means any compound or protecting group known to those having skill in the art. Non-limiting examples of protecting groups may be found in "Protective Groups in Organic Chemistry", T. W. Greene, P. G. M. Wuts, ISBN 0-471-62301-6, John Wiley & Sons, Inc, New York, which is incorporated herein by reference in its entirety.

"Region" is defined as a portion of the target nucleic acid having at least one identifiable structure, function, or characteristic.

"Ribonucleotide" means a nucleotide having a hydroxy at the 2' position of the sugar portion of the nucleotide. Ribonucleotides may be modified with any of a variety of substituents.

"RISC based antisense compound" means an antisense compound wherein at least some of the antisense activity of the antisense compound is attributable to the RNA Induced Silencing Complex (RISC).

"RNase H based antisense compound" means an antisense compound wherein at least some of the antisense activity of the antisense compound is attributable to hybridization of the antisense compound to a target nucleic acid and subsequent cleavage of the target nucleic acid by RNase H.

"Salts" mean a physiologically and pharmaceutically acceptable salts of antisense compounds, i.e., salts that retain the desired biological activity of the parent oligonucleotide and do not impart undesired toxicological effects thereto.

"Segments" are defined as smaller or sub-portions of regions within a target nucleic acid.

"Separate regions" means portions of an oligonucleotide wherein the chemical modifications or the motif of chemical modifications of any neighboring portions include at least one difference to allow the separate regions to be distinguished from one another.

"Sequence motif" means a pattern of nucleobases arranged along an oligonucleotide or portion thereof. Unless otherwise indicated, a sequence motif is independent of chemical modifications and thus may have any combination of chemical modifications, including no chemical modifications.

"Side effects" means physiological responses attributable to a treatment other than desired effects. In certain embodiments, side effects include, without limitation, injection site reactions, liver function test abnormalities, renal function abnormalities, liver toxicity, renal toxicity, central nervous system abnormalities, and myopathies.

"Single-stranded oligonucleotide" means an oligonucleotide which is not hybridized to a complementary strand.

"Sites," as used herein, are defined as unique nucleobase positions within a target nucleic acid.

"Specifically hybridizable" or "specifically hybridizes" refers to an antisense compound having a sufficient degree of complementarity between an antisense oligonucleotide and a target nucleic acid to induce a desired effect, while exhibiting minimal or no effects on non-target nucleic acids under conditions in which specific binding is desired, i.e., under physiological conditions in the case of in vivo assays and therapeutic treatments.

"Stringent hybridization conditions" or "stringent conditions" refer to conditions under which an oligomeric compound will hybridize to its target sequence, but to a minimal number of other sequences.

"Subject" means a human or non-human animal selected for treatment or therapy.

"Substituent" and "substituent group," means an atom or group that replaces the atom or group of a named parent compound. For example a substituent of a modified nucleoside is any atom or group that differs from the atom or group found in a naturally occurring nucleoside (e.g., a modified 2'-substituent is any atom or group at the 2'-position of a nucleoside other than H or OH). Substituent groups can be protected or unprotected. In certain embodiments, compounds of the present disclosure have substituents at one or at more than one position of the parent compound. Substituents may also be further substituted with other substituent groups and may be attached directly or via a linking group such as an alkyl or hydrocarbyl group to a parent compound.

Likewise, as used herein, "substituent" in reference to a chemical functional group means an atom or group of atoms that differs from the atom or a group of atoms normally present in the named functional group. In certain embodiments, a substituent replaces a hydrogen atom of the functional group (e.g., in certain embodiments, the substituent of a substituted methyl group is an atom or group other than hydrogen which replaces one of the hydrogen atoms of an unsubstituted methyl group). Unless otherwise indicated, groups amenable for use as substituents include without limitation, halogen, hydroxyl, alkyl, alkenyl, alkynyl, acyl (—C(O)$R_{aa}$), carboxyl (—C(O)O—$R_{aa}$), aliphatic groups, alicyclic groups, alkoxy, substituted oxy (—O—$R_{aa}$), aryl, aralkyl, heterocyclic radical, heteroaryl, heteroarylalkyl, amino (—N($R_{bb}$)($R_{cc}$)), imino(=N$R_{bb}$), amido (—C(O)N($R_{bb}$)($R_{cc}$) or —N($R_{bb}$)C(O)$R_{aa}$), azido (—$N_3$), nitro (—$NO_2$), cyano (—CN), carbamido (—OC(O)N($R_{bb}$)($R_{cc}$) or —N($R_{bb}$)C(O)O$R_{aa}$), ureido (—N($R_{bb}$)C(O)N($R_{bb}$)($R_{cc}$)), thioureido (—N($R_{bb}$)C(S)N($R_{bb}$)—($R_{cc}$)), guanidinyl (—N($R_{bb}$)C(=N$R_{bb}$)N($R_{bb}$)($R_{cc}$)), amidinyl (—C(=N$R_{bb}$)N($R_{bb}$)($R_{cc}$) or —N($R_{bb}$)C(=N$R_{bb}$)($R_{aa}$)), thiol (—S$R_{bb}$), sulfinyl (—S(O)$R_{bb}$), sulfonyl (—S(O)$_2R_{bb}$) and sulfonamidyl (—S(O)$_2$N($R_{bb}$)($R_{cc}$) or —N($R_{bb}$)S—(O)$_2R_{bb}$). Wherein each $R_{aa}$, $R_{bb}$ and $R_{cc}$ is, independently, H, an optionally linked chemical functional group or a further substituent group with a preferred list including without limitation, alkyl, alkenyl, alkynyl, aliphatic, alkoxy, acyl, aryl, aralkyl, heteroaryl, alicyclic, heterocyclic and heteroarylalkyl. Selected substituents within the compounds described herein are present to a recursive degree.

"Substituted sugar moiety" means a furanosyl that is not a naturally occurring sugar moiety. Substituted sugar moieties include, but are not limited to furanosyls comprising substituents at the 2'-position, the 3'-position, the 5'-position and/or the 4'-position. Certain substituted sugar moieties are bicyclic sugar moieties.

"Sugar moiety" means a naturally occurring sugar moiety or a modified sugar moiety of a nucleoside.

"Sugar motif" means a pattern of sugar modifications in an oligonucleotide or a region thereof.

"Sugar surrogate" means a structure that does not comprise a furanosyl and that is capable of replacing the naturally occurring sugar moiety of a nucleoside, such that the resulting nucleoside sub-units are capable of linking together and/or linking to other nucleosides to form an oligomeric compound which is capable of hybridizing to a complementary oligomeric compound. Such structures include rings comprising a different number of atoms than furanosyl (e.g., 4, 6, or 7-membered rings); replacement of the oxygen of a furanosyl with a non-oxygen atom (e.g., carbon, sulfur, or nitrogen); or both a change in the number of atoms and a replacement of the oxygen. Such structures may also comprise substitutions corresponding to those described for substituted sugar moieties (e.g., 6-membered carbocyclic bicyclic sugar surrogates optionally comprising additional substituents). Sugar surrogates also include more complex sugar replacements (e.g., the non-ring systems of peptide nucleic acid). Sugar surrogates include without limitation morpholinos, cyclohexenyls and cyclohexitols.

"Target" refers to a protein, the modulation of which is desired.

"Target gene" refers to a gene encoding a target.

"Targeting" or "targeted" means the process of design and selection of an antisense compound that will specifically hybridize to a target nucleic acid and induce a desired effect.

"Target nucleic acid," "target RNA," and "target RNA transcript" and "nucleic acid target" all mean a nucleic acid capable of being targeted by antisense compounds.

"Target region" means a portion of a target nucleic acid to which one or more antisense compounds is targeted.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"Terminal group" means one or more atom attached to either, or both, the 3' end or the 5' end of an oligonucleotide. In certain embodiments a terminal group is a conjugate group. In certain embodiments, a terminal group comprises one or more terminal group nucleosides.

"Terminal internucleoside linkage" means the linkage between the last two nucleosides of an oligonucleotide or defined region thereof.

"Therapeutically effective amount" means an amount of a pharmaceutical agent that provides a therapeutic benefit to an individual.

"Treat" or "treating" or "treatment" refers to administering a composition to effect an improvement of the disease or condition.

"Type of modification" in reference to a nucleoside or a nucleoside of a "type" means the chemical modification of a nucleoside and includes modified and unmodified nucleosides. Accordingly, unless otherwise indicated, a "nucleoside having a modification of a first type" may be an unmodified nucleoside.

"Unmodified nucleobases" mean the purine bases adenine (A) and guanine (G), and the pyrimidine bases thymine (T), cytosine (C) and uracil (U).

"Unmodified nucleotide" means a nucleotide composed of naturally occurring nucleobases, sugar moieties, and internucleoside linkages. In certain embodiments, an unmodified nucleotide is an RNA nucleotide (i.e. β-D-ribonucleosides) or a DNA nucleotide (i.e. β-D-deoxyribonucleoside).

"Upstream" refers to the relative direction toward the 5' end or N-terminal end of a nucleic acid.

"Wing segment" means a plurality of nucleosides modified to impart to an oligonucleotide properties such as enhanced inhibitory activity, increased binding affinity for a target nucleic acid, or resistance to degradation by in vivo nucleases.

Certain Embodiments

Certain embodiments provide compounds, compositions, and methods for inhibiting plasma prekallikrein (PKK) mRNA and protein expression. Certain embodiments provide compounds, compositions, and methods for decreasing PKK mRNA and protein levels.

Certain embodiments provide antisense compounds targeted to a plasma prekallikrein (PKK) nucleic acid. In certain embodiments, the PKK nucleic acid is the sequence set forth in GENBANK Accession No. NM_000892.3 (incorporated herein as SEQ ID NO: 1), GENBANK Accession No. DC412984.1 (incorporated herein as SEQ ID NO: 2), GENBANK Accession No. CN265612.1 (incorporated herein as SEQ ID NO: 3), GENBANK Accession No. AK297672.1 (incorporated herein as SEQ ID NO: 4), GENBANK Accession No. DC413312.1 (incorporated herein as SEQ ID NO: 5), GENBANK Accession No. AV688858.2

(incorporated herein as SEQ ID NO: 6), GENBANK Accession No. CD652077.1 (incorporated herein as SEQ ID NO: 7), GENBANK Accession No. BC143911.1 (incorporated herein as SEQ ID NO: 8), GENBANK Accession No. CB162532.1 (incorporated herein as SEQ ID NO: 9), GENBANK Accession No. NT_016354.19 truncated from nucleobases 111693001 to 11730000 (incorporated herein as SEQ ID NO: 10), GENBANK Accession No. NM_008455.2 (incorporated herein as SEQ ID NO: 11), GENBANK Accession No. BB598673.1 (incorporated herein as SEQ ID NO: 12), GENBANK Accession No. NT_039460.7 truncated from nucleobases 6114001 to 6144000 (incorporated herein as SEQ ID NO: 13), GENBANK Accession No. NM_012725.2 (incorporated herein as SEQ ID NO: 14), GENBANK Accession No. NW_047473.1 truncated from nucleobases 10952001 to 10982000 (incorporated herein as SEQ ID NO: 15), GENBANK Accession No. XM_002804276.1 (incorporated herein as SEQ ID NO: 17), and GENBANK Accession No. NW_001118167.1 truncated from nucleobases 2358000 to 2391000 (incorporated herein as SEQ ID NO: 18).

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 30-2226.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, at least 16, at least 17, at least 18, at least 19, or at least 20 consecutive nucleobases of the nucleobase sequence of SEQ ID NO: 570.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, at least 16, at least 17, at least 18, at least 19, or at least 20 consecutive nucleobases of the nucleobase sequence of SEQ ID NO: 705.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, or at least 16 consecutive nucleobases of the nucleobase sequence of SEQ ID NO: 1666.

Certain embodiments provide compounds, comprising a modified oligonucleotide and a conjugate group, wherein the modified oligonucleotide consists of 20 linked nucleosides and has the nucleobase sequence of SEQ ID NO: 570.

Certain embodiments provide compounds, comprising a modified oligonucleotide and a conjugate group, wherein the modified oligonucleotide consists of 20 linked nucleosides and has the nucleobase sequence of SEQ ID NO: 705.

Certain embodiments provide compounds, comprising a modified oligonucleotide and a conjugate group, wherein the modified oligonucleotide consists of 16 linked nucleosides and has the nucleobase sequence of SEQ ID NO: 1666.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 62, 72, 103, 213, 312, 334-339, 344, 345, 346, 348, 349, 351, 369, 373, 381, 382, 383, 385, 387-391, 399, 411, 412, 414, 416, 444, 446-449, 452, 453, 454, 459, 460, 462-472, 473, 476, 477, 479, 480, 481, 484, 489-495, 497, 500, 504, 506, 522, 526, 535, 558, 559, 560, 564, 566, 568-571, 573, 576, 577, 578, 587, 595, 597-604, 607, 608, 610, 613, 615, 618, 619, 622, 623, 624, 633, 635, 636, 638, 639, 640, 642, 643, 645, 652, 655-658, 660, 661, 670, 674-679, 684, 685, 698, 704, 705, 707, 708, 713, 716, 717, 728, 734, 736, 767, 768, 776, 797, 798, 800, 802, 810, 815, 876, 880, 882, 883, 886, 891, 901-905, 908-911, 922, 923, 924, 931, 942, 950-957, 972, 974, 978, 979, 980, 987-991, 1005, 1017-1021, 1025, 1026, 1029, 1030, 1032, 1034, 1035, 1037, 1040, 1041, 1045, 1046, 1051, 1054, 1059, 1060, 1061, 1064, 1065, 1066, 1075, 1076, 1087, 1089, 1111, 1114, 1116, 1117, 1125, 1133, 1153, 1169, 1177, 1181, 1182, 1187, 1196, 1200, 1214, 1222, 1267, 1276, 1277, 1285, 1286, 1289, 1290, 1291, 1303, 1367, 1389, 1393, 1398-1401, 1406, 1407, 1408, 1411, 1419-1422, 1426, 1430, 1431, 1432, 1434-1437, 1439, 1440, 1443, 1444, 1451, 1452, 1471, 1516, 1527, 1535, 1537, 1538, 1539, 1540, 1541, 1563, 1564, 1567, 1568, 1616, 1617, 1623, 1629, 1664, 1665, 1666, 1679, 1687, 1734, 1804, 1876, 1886, 1915, 2008, 2018, 2100, 2101, 2115, and 2116. In certain embodiments, the modified oligonucleotide achieves at least 80% mRNA inhibition of PKK.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 62, 72, 103, 213, 334-339, 344, 346, 348, 349, 351, 381, 382, 383, 385, 389, 390, 391, 446, 448, 452, 453, 454, 466-473, 476, 481, 484, 491, 492, 494, 495, 497, 504, 526, 558, 559, 566, 568-571, 576, 578, 587, 595, 597, 598, 600-604, 607, 610, 613, 618, 619, 624, 635, 638, 639, 645, 652, 656, 657, 658, 660, 674, 675, 676, 684, 698, 704, 705, 707, 713, 716, 768, 876, 880, 901-905, 908-911, 922, 923, 924, 931, 942, 951, 954-957, 972, 974, 978, 979, 987, 988, 990, 1005, 1019, 1020, 1021, 1025, 1032, 1037, 1040, 1041, 1045, 1054, 1059, 1060, 1061, 1064, 1065, 1066, 1075, 1111, 1116, 1117, 1125, 1133, 1153, 1169, 1177, 1200, 1222, 1267, 1285, 1290, 1291, 1303, 1367, 1398, 1399, 1401, 1406, 1408, 1411, 1419, 1420, 1421, 1426, 1430, 1431, 1432, 1434-1437, 1440, 1443, 1444, 1451, 1537-1540, 1563, 1616, 1679, 1687, 1804, 2008, 2101, 2115, and 2116. In certain embodiments, the modified oligonucleotide achieves at least 85% mRNA inhibition of PKK.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 346, 351, 382, 390, 391, 446, 448, 452, 453, 468, 469, 470, 471, 472, 476, 481, 491, 495, 504, 558, 566, 568, 570, 571, 578, 587, 597, 598, 600, 604, 613, 635, 638, 645, 656, 658, 660, 674, 675, 684, 704, 705, 880, 901-905, 909, 922, 931, 951, 954, 956, 990, 1005, 1020, 1032, 1037, 1040, 1041, 1045, 1054, 1075, 1111, 1125, 1133, 1153, 1200, 1267, 1291, 1303, 1398, 1399, 1401, 1406, 1420, 1426, 1430, 1431, 1434, 1435, 1436, 1440, 1443, 1451, 1537-1540, 2115, and 2116. In certain embodiments, the modified oligonucleotide achieves at least 90% mRNA inhibition of PKK.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 391, 448, 468, 469, 568, 570, 598, 635, 658, 674, 684, 705, 901, 903, 904, 922, 990, 1267, 1291, 1420, 1430, 1431, 1434, 1435, 1436, 1537, 1538, and 1540. In certain embodiments, the modified oligonucleotide achieves at least 95% mRNA inhibition of PKK.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 338, 346, 349, 382, 383, 390, 448, 452, 453, 454, 495, 526, 559, 570, 587, 598, 635, 660, 705, 901, 903, 904, 908, 923, 931, 955, 974, 988, 990, 1020, 1039, 1040, 1111, 1117, 1267, 1291, 1349, 1352, 1367, 1389, 1393, 1399, 1401, 1408, 1411, 1426, 1499, 1516, 1535, 1544, 1548, 1563, 1564, 1568, 1569, 1598, 1616, 1617, 1623, 1624, 1643, 1661, 1665, 1666, 1673, 1679, 1695, 1720, 1804, 1817, 1876, 1881, 1886, 1940, 1947, 2008, 2018, 2019, 2031, 2044, 2100, 2101, 2115, and 2116. In certain embodiments, the modified oligonucleotide achieves an $IC_{50}$ ($\mu M$) of 0.4 or less.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 346, 349, 382, 453, 454, 495, 526, 570, 587, 598, 635, 660, 901, 903, 904, 931, 955, 990, 1020, 1111, 1267, 1349, 1352, 1367, 1389, 1399, 1408, 1411, 1426, 1516, 1535, 1544, 1548, 1563, 1564, 1568, 1569, 1598, 1616, 1617, 1623, 1643, 1661, 1665, 1666, 1673, 1695, 1804, 1876, 1881, 2019, 2044, 2100, 2101, 2115, and 2116. In certain embodiments, the modified oligonucleotide achieves an $IC_{50}$ ($\mu M$) of 0.3 or less.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 346, 382, 453, 495, 526, 570, 587, 598, 635, 901, 904, 931, 955, 1020, 1111, 1349, 1352, 1389, 1426, 1516, 1535, 1544, 1548, 1564, 1569, 1598, 1616, 1617, 1665, 1666, 1804, 1876, 1881, 2019, 2044, 2101, and 2116. In certain embodiments, the modified oligonucleotide achieves an $IC_{50}$ ($\mu M$) of 0.2 or less.

Certain embodiments provide compounds, comprising a modified oligonucleotide and a conjugate group, wherein the modified oligonucleotide consists of 12 to 30 linked nucleosides and has a nucleobase sequence comprising at least 8, at least 9, at least 10, at least 11, at least 12, at least 13, at least 14, at least 15, or at least 16 consecutive nucleobases of any of the nucleobase sequences of SEQ ID NOs: 334, 495, 587, 598, 635, 1349, 1352, 1389, 1516, 1544, 1548, 1569, 1598, 1617, 1665, 1666, 1804, 1881, and 2019. In certain embodiments, the modified oligonucleotide achieves an $IC_{50}$ ($\mu M$) of less than 0.2.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 27427-27466 of SEQ ID NO: 10.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 33183-33242 of SEQ ID NO: 10.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 30570-30610 of SEQ ID NO: 10.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 27427-27520 of SEQ ID NO: 10.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 33085-33247 of SEQ ID NO: 10.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 30475-30639 of SEQ ID NO: 10.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 27362-27524 of SEQ ID NO: 10.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 33101-33240 of SEQ ID NO: 10.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 30463-30638 of SEQ ID NO: 10.

Certain embodiments provide compounds, comprising a modified oligonucleotide and a conjugate group, wherein the modified oligonucleotide consists of 12 to 30 linked nucleosides and comprises a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of exon 9, exon 12, or exon 14 of a PKK nucleic acid.

In certain embodiments the nucleobase sequence of the modified oligonucleotide is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% complementary to SEQ ID NO: 10.

In certain embodiments, the compound consists of a single-stranded modified oligonucleotide.

In certain embodiments, at least one internucleoside linkage of the modified oligonucleotide is a modified internucleoside linkage.

In certain embodiments, at least one modified internucleoside linkage of the modified oligonucleotide is a phosphorothioate internucleoside linkage.

In certain embodiments, the modified oligonucleotide comprises at least 1, 2, 3, 4, 5, 6, or 7 phosphodiester internucleoside linkages.

In certain embodiments, each internucleoside linkage of the modified oligonucleotide is selected from a phosphodiester internucleoside linkage and a phosphorothioate internucleoside linkage.

In certain embodiments, each internucleoside linkage of the modified oligonucleotide is a phosphorothioate linkage.

In certain embodiments, at least one nucleoside of the modified oligonucleotide comprises a modified nucleobase.

In certain embodiments, the modified nucleobase is a 5-methylcytosine.

In certain embodiments, the modified oligonucleotide comprises at least one modified sugar.

In certain embodiments, the modified sugar is a 2' modified sugar, a BNA, or a THP.

In certain embodiments, the modified sugar is any of a 2'-O-methoxyethyl, 2'-O-methyl, a constrained ethyl, a LNA, or a 3'-fluoro-HNA.

In certain embodiments, the compound comprises at least one 2'-O-methoxyethyl nucleoside, 2'-O-methyl nucleoside, constrained ethyl nucleoside, LNA nucleoside, or 3'-fluoro-HNA nucleoside.

In certain embodiments, the modified oligonucleotide comprises:
  a gap segment consisting of 10 linked deoxynucleosides;
  a 5' wing segment consisting of 5 linked nucleosides; and
  a 3' wing segment consisting of 5 linked nucleosides;
  wherein the gap segment is positioned between the 5' wing segment and the 3' wing segment and wherein each nucleoside of each wing segment comprises a modified sugar.

In certain embodiments, the modified oligonucleotide consists of 20 linked nucleosides.

In certain embodiments, the modified oligonucleotide consists of 19 linked nucleosides.

In certain embodiments, the modified oligonucleotide consists of 18 linked nucleosides.

Certain embodiments provide compounds consisting of a conjugate group and a modified oligonucleotide according to the following formula: Tes Ges mCes Aes Aes Gds Tds mCds Tds mCds Tds Tds Gds Gds mCds Aes Aes Aes mCes Ae; wherein, A=an adenine,
mC=a 5'-methylcytosine
G=a guanine,
T=a thymine,
e=a 2'-O-methoxyethyl modified nucleoside,
d=a 2'-deoxynucleoside, and
s=a phosphorothioate internucleoside linkage.

Certain embodiments provide compounds consisting of a conjugate group and a modified oligonucleotide according to the following formula: mCes mCes mCes mCes mCes Tds Tds mCds Tds Tds Tds Ads Tds Ads Gds mCes mCes Aes Ges mCe; wherein, A=an adenine,
mC=a 5'-methylcytosine;
G=a guanine,
T=a thymine,
e=a 2'-O-methoxyethyl modified nucleoside,
d=a 2'-deoxynucleoside, and
s=a phosphorothioate internucleoside linkage.

Certain embodiments provide compounds consisting of a conjugate group and a modified oligonucleotide according to the following formula: mCes Ges Aks Tds Ads Tds mCds Ads Tds Gds Ads Tds Tds mCks mCks mCe; wherein, A=an adenine,
mC=a 5'-methylcytosine;
G=a guanine,
T=a thymine,
e=a 2'-O-methoxyethyl modified nucleoside,
k=a cEt modified nucleoside,
d=a 2'-deoxynucleoside, and
s=a phosphorothioate internucleoside linkage.

In certain embodiments, the conjugate group is linked to the modified oligonucleotide at the 5' end of the modified oligonucleotide. In certain embodiments, the conjugate group is linked to the modified oligonucleotide at the 3' end of the modified oligonucleotide. In certain embodiments, the conjugate group comprises at least one N-Acetylgalactosamine (GalNAc), at least two N-Acetylgalactosamines (GalNAcs), or at least three N-Acetylgalactosamines (GalNAcs).

Certain embodiments provide compounds according to the following formula:

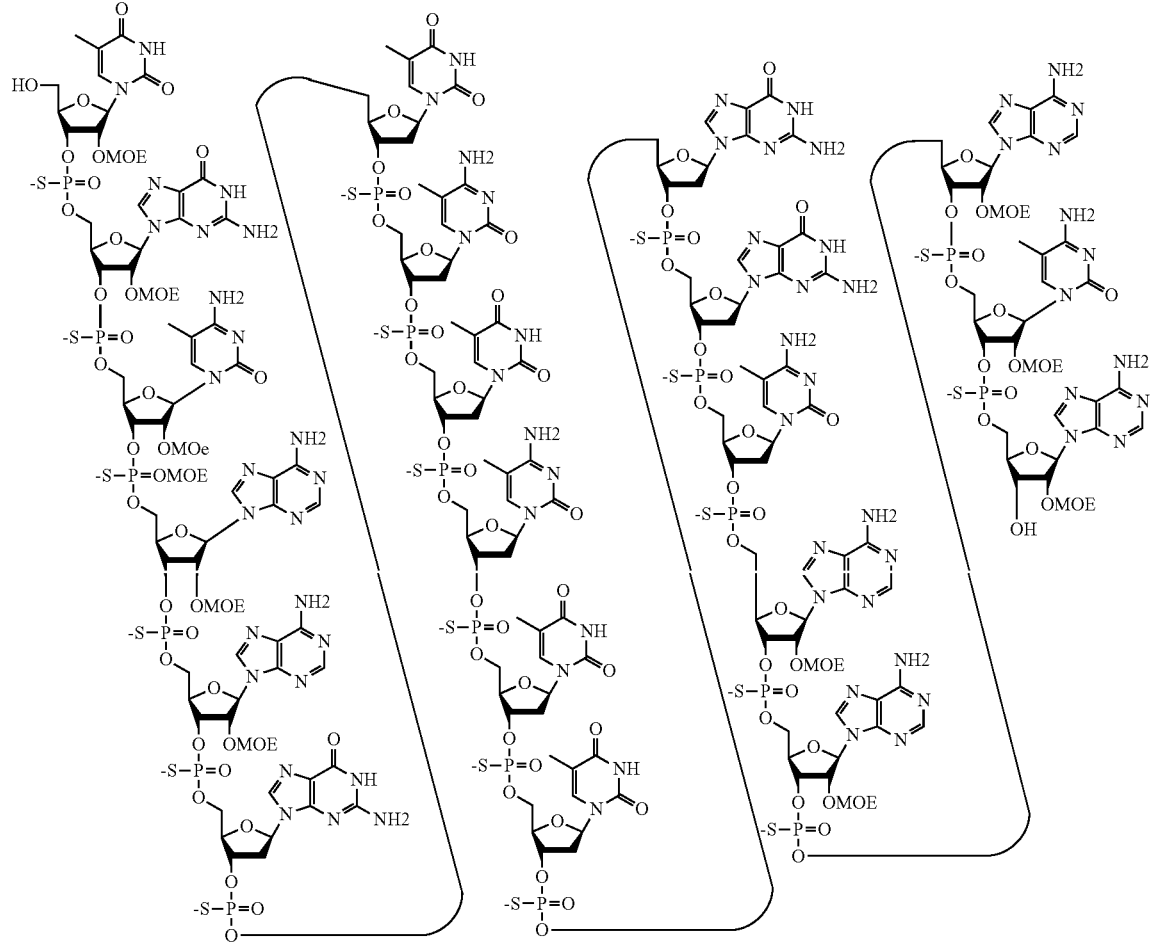

Certain embodiments provide compounds according to the following formula:
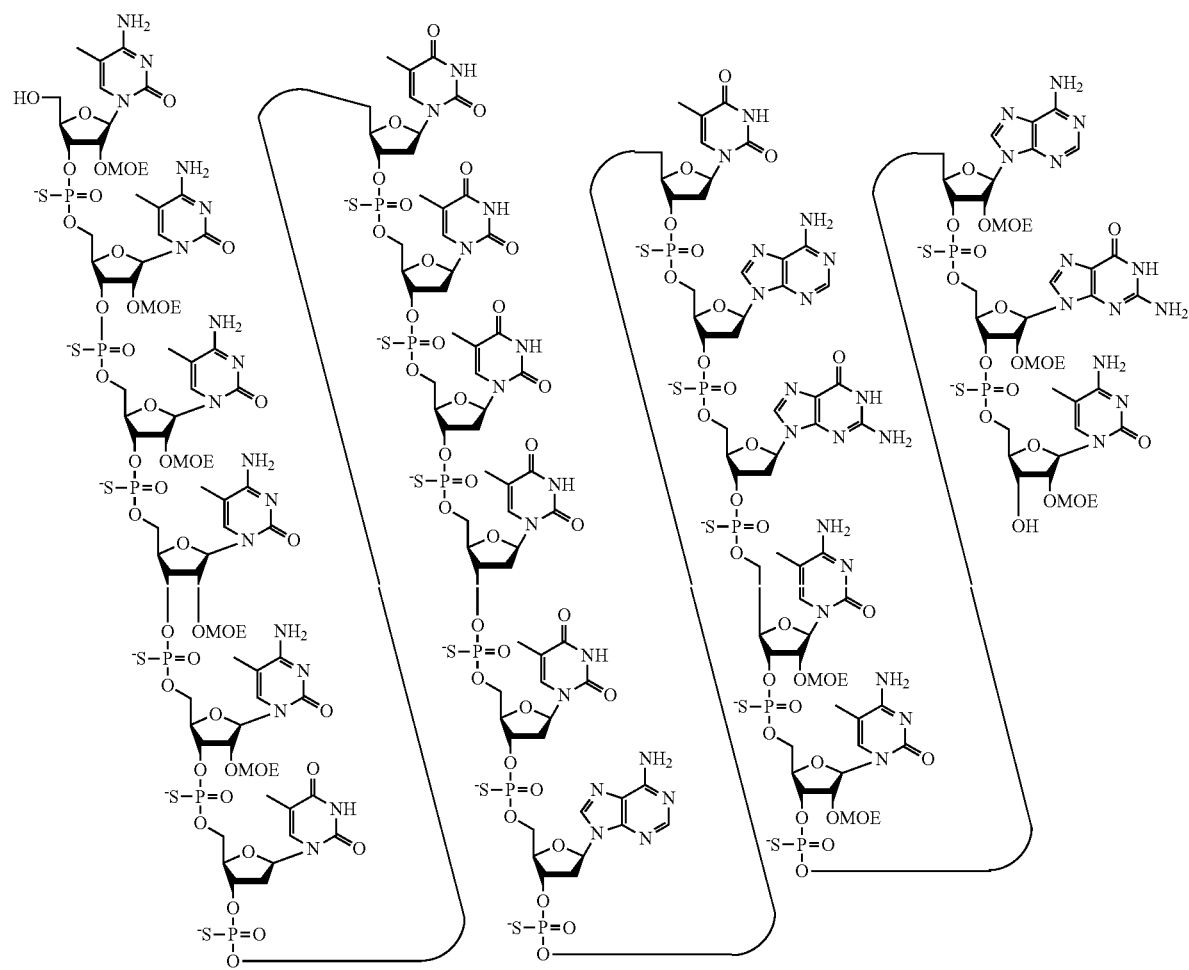
Certain embodiments provide compounds according to the following formula:

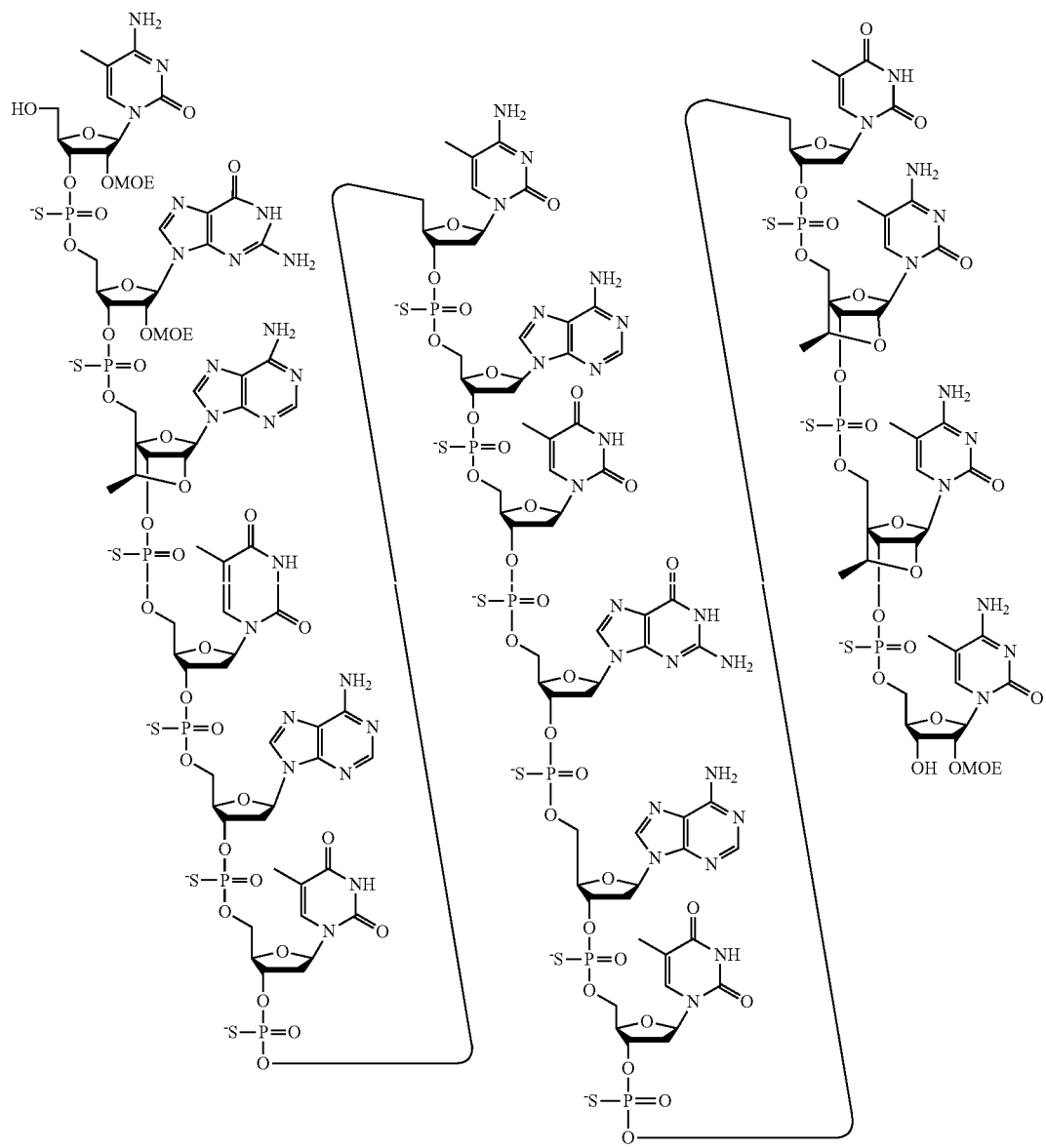
In certain embodiments, a compound can comprise or consist of any modified oligonucleotide described herein and a conjugate group. In certain embodiments, a compound can comprise or consist of a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 30-2226, and a conjugate group.
In certain embodiments, a compound having the following chemical structure comprises or consists of ISIS 721744 with a 5'-X, wherein X is a conjugate group comprising GalNAc as described herein:
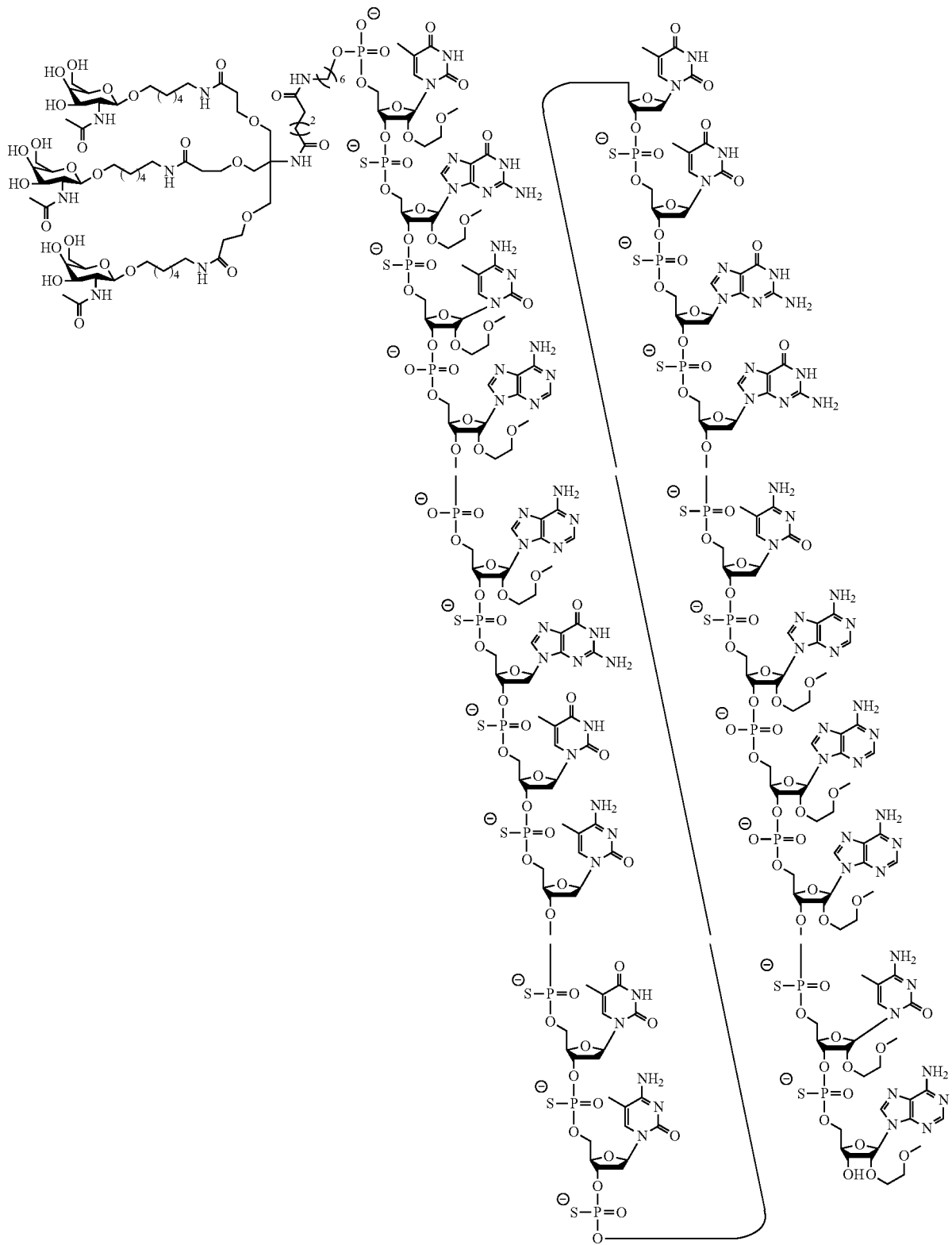

In certain embodiments, a compound having the following chemical structure comprises or consists of ISIS 546254 with a 5'-X, wherein X is a conjugate group comprising GalNAc as described herein:
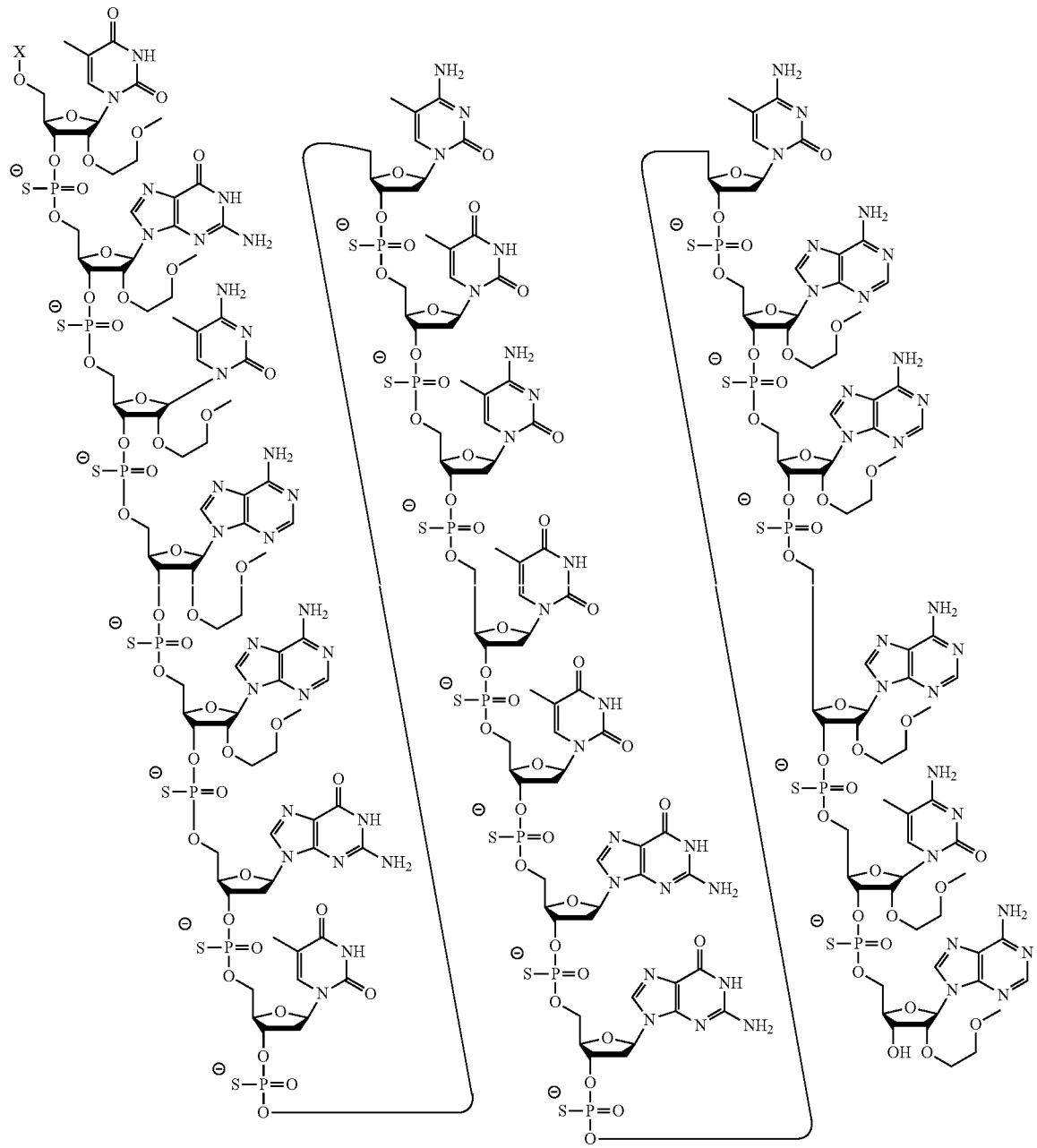
Certain embodiments provide a compound comprising or consisting of the following formula:

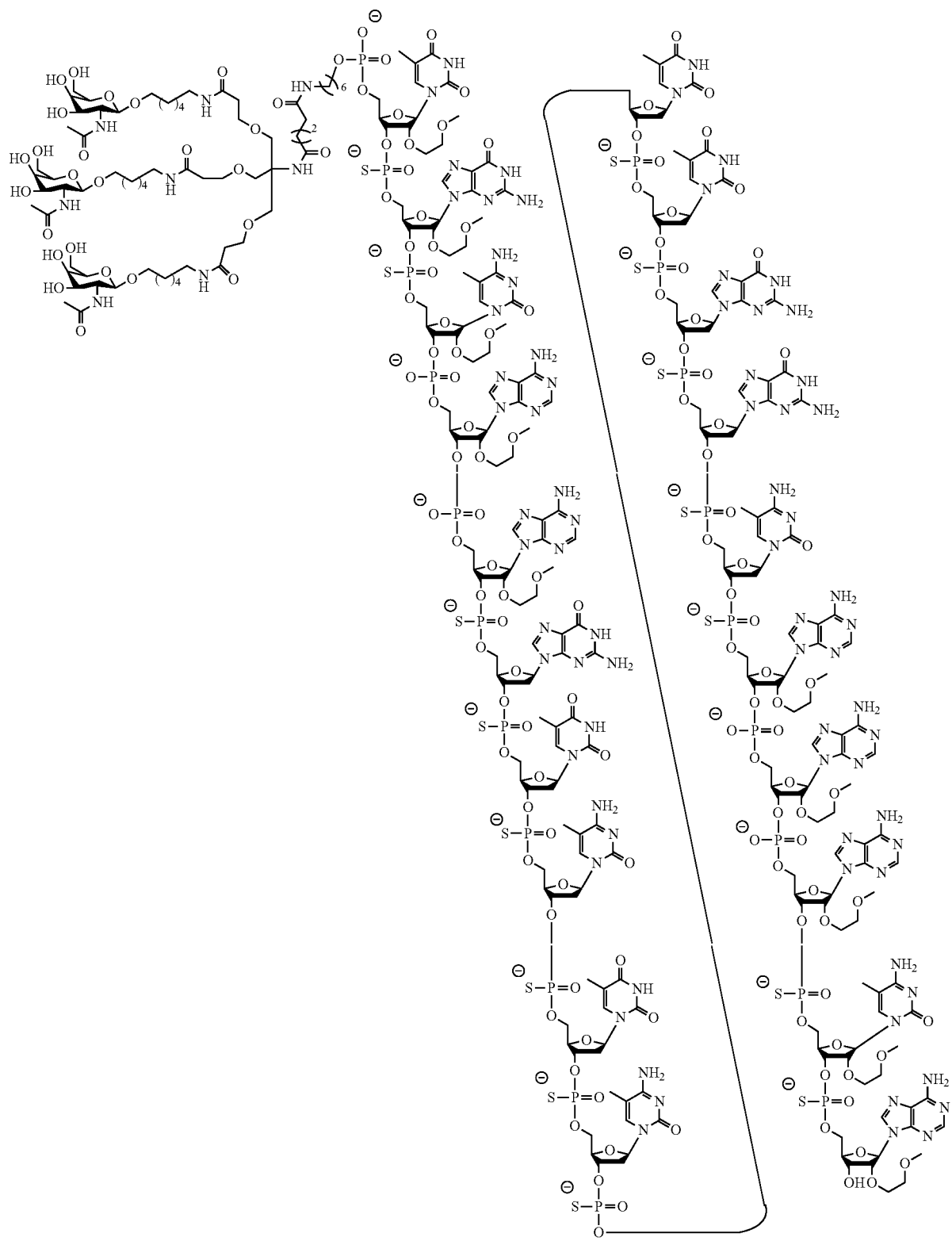
Certain embodiments provide a compound comprising or consisting of the following formula:

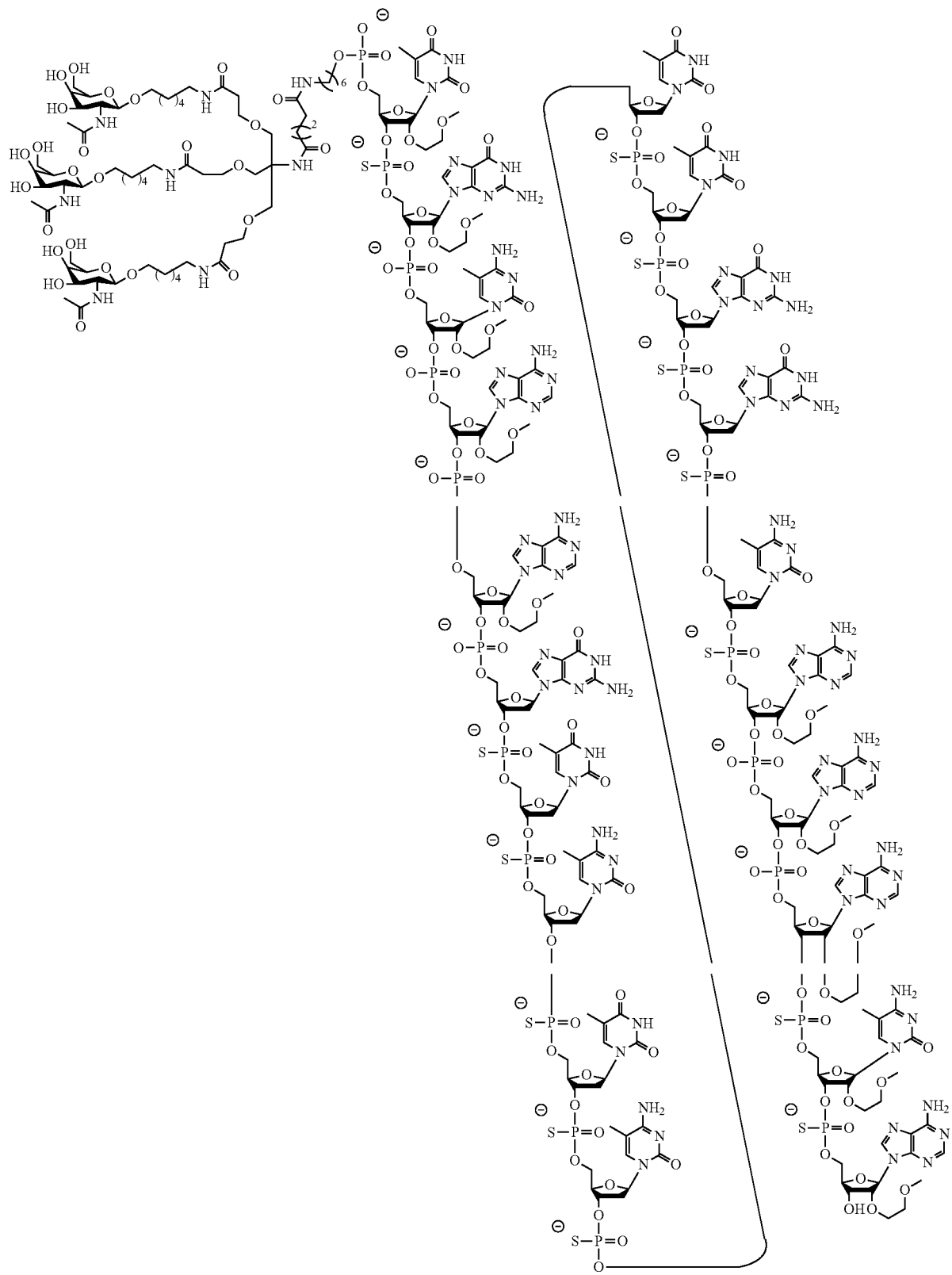

Certain embodiments provide a compound comprising or consisting of the following formula:
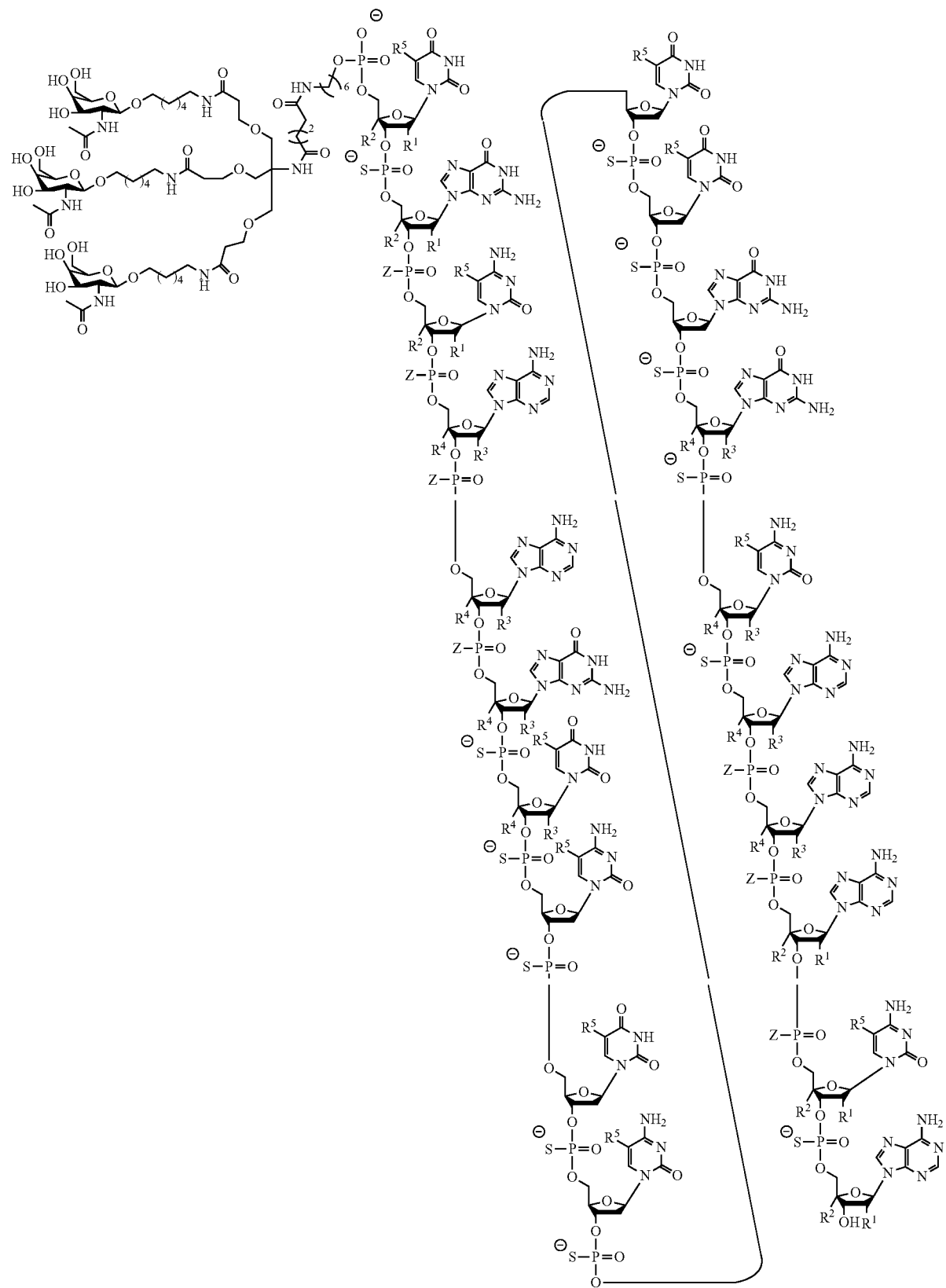

wherein either R$^1$ is —OCH$_2$CH$_2$OCH$_3$ (MOE) and R$^2$ is H; or R$^1$ and R$^2$ together form a bridge, wherein R$^1$ is —O— and R$^2$ is —CH$_2$—, —CH(CH$_3$)—, or —CH$_2$CH$_2$—, and R$^1$ and R$^2$ are directly connected such that the resulting bridge is selected from: —O—CH$_2$—, —O—CH(CH$_3$)—, and —O—CH$_2$CH$_2$—;

and for each pair of R$^3$ and R$^4$ on the same ring, independently for each ring: either R$^3$ is selected from H and —OCH$_2$CH$_2$OCH$_3$ and R$^4$ is H; or R$^3$ and R$^4$ together form a bridge, wherein R$^3$ is —O—, and R$^4$ is —CH$_2$—, —CH(CH$_3$)—, or —CH$_2$CH$_2$— and R$^3$ and R$^4$ are directly connected such that the resulting bridge is selected from: —O—CH$_2$—, —O—CH(CH$_3$)—, and —O—CH$_2$CH$_2$—;

and R$^5$ is selected from H and —CH$_3$;

and Z is selected from S$^-$ and O$^-$.

Certain embodiments provide compositions comprising the compound of any preceding claim or salt thereof and at least one of a pharmaceutically acceptable carrier or diluent.

Certain embodiments provide methods comprising administering to an animal the compound or composition of any preceding claim.

In certain embodiments, the animal is a human.

In certain embodiments, administering the compound prevents, treats, or ameliorates a PKK associated disease, disorder or condition.

In certain embodiments, the PKK associated disease, disorder or condition is a hereditary angioedema (HAE), edema, angioedema, swelling, angioedema of the lids, ocular edema, macular edema, cerebral edema, thrombosis, embolism, thromboembolism, deep vein thrombosis, pulmonary embolism, myocardial infarction, stroke, or infarct.

Certain embodiments provide use of the compound or composition of any preceding claim for the manufacture of a medicament for treating an inflammatory disease or a thromboembolic disease.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound may be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound targeted to a PKK nucleic acid is 12 to 30 subunits in length. In certain embodiments, an antisense compound targeted to PKK nucleic acid is 12 to 25 subunits in length. In certain embodiments, an antisense compound targeted to PKK nucleic acid is 12 to 22 subunits in length. In certain embodiments, an antisense compound targeted to PKK nucleic acid is 14 to 20 subunits in length. In certain embodiments, an antisense compound targeted to PKK nucleic acid is 15 to 25 subunits in length. In certain embodiments, an antisense compound targeted to PKK nucleic acid is 18 to 22 subunits in length. In certain embodiments, an antisense compound targeted to PKK nucleic acid is 19 to 21 subunits in length. In certain embodiments, the antisense compound is 8 to 80, 12 to 50, 13 to 30, 13 to 50, 14 to 30, 14 to 50, 15 to 30, 15 to 50, 16 to 30, 16 to 50, 17 to 30, 17 to 50, 18 to 30, 18 to 50, 19 to 30, 19 to 50, or 20 to 30 linked subunits in length.

In certain embodiments, an antisense compound targeted to a PKK nucleic acid is 12 subunits in length. In certain embodiments, an antisense compound targeted to a PKK nucleic acid is 13 subunits in length. In certain embodiments, an antisense compound targeted to a PKK nucleic acid is 14 subunits in length. In certain embodiments, an antisense compound targeted to a PKK nucleic acid is 15 subunits in length. In certain embodiments, an antisense compound targeted to a PKK nucleic acid is 16 subunits in length. In certain embodiments, an antisense compound targeted to a PKK nucleic acid is 17 subunits in length. In certain embodiments, an antisense compound targeted to a PKK nucleic acid is 18 subunits in length. In certain embodiments, an antisense compound targeted to a PKK nucleic acid is 19 subunits in length. In certain embodiments, an antisense compound targeted to a PKK nucleic acid is 20 subunits in length. In certain embodiments, an antisense compound targeted to a PKK nucleic acid is 21 subunits in length. In certain embodiments, an antisense compound targeted to a PKK nucleic acid is 22 subunits in length. In certain embodiments, an antisense compound targeted to a PKK nucleic acid is 23 subunits in length. In certain embodiments, an antisense compound targeted to a PKK nucleic acid is 24 subunits in length. In certain embodiments, an antisense compound targeted to a PKK nucleic acid is 25 subunits in length. In certain embodiments, an antisense compound targeted to a PKK nucleic acid is 26 subunits in length. In certain embodiments, an antisense compound targeted to a PKK nucleic acid is 27 subunits in length. In certain embodiments, an antisense compound targeted to a PKK nucleic acid is 28 subunits in length. In certain embodiments, an antisense compound targeted to a PKK nucleic acid is 29 subunits in length. In certain embodiments, an antisense compound targeted to a PKK nucleic acid is 30 subunits in length. In certain embodiments, the antisense compound targeted to a PKK nucleic acid is 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In certain embodiments the antisense compound is an antisense oligonucleotide, and the linked subunits are nucleosides.

In certain embodiments antisense oligonucleotides targeted to a PKK nucleic acid may be shortened or truncated. For example, a single subunit may be deleted from the 5' end (5' truncation), or alternatively from the 3' end (3' truncation). A shortened or truncated antisense compound targeted to a PKK nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two or more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Antisense Compound Motifs

In certain embodiments, antisense compounds targeted to a PKK nucleic acid have chemically modified subunits arranged in patterns, or motifs, to confer to the antisense compounds properties such as enhanced inhibitory activity, increased binding affinity for a target nucleic acid, or resistance to degradation by in vivo nucleases.

Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may optionally serve as a substrate for the cellular endonuclease RNase H, which cleaves the RNA strand of an RNA:DNA duplex.

Antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, 2'-modified nucleosides (such 2'-modified nucleosides may include 2'-MOE, and 2'-O—CH$_3$, among others), and bicyclic sugar modified nucleosides (such bicyclic sugar modified nucleosides may include those having a 4'-(CH$_2$)n-O-2' bridge, where n=1 or n=2 and 4'-CH$_2$—O—CH$_2$-2'). In certain embodiments, wings may include several modified sugar moieties, including, for example 2'-MOE. In certain embodiments, wings may include several modified and unmodified sugar moieties. In certain embodiments, wings may include various combinations of 2'-MOE nucleosides and 2'-deoxynucleosides.

Each distinct region may comprise uniform sugar moieties, variant, or alternating sugar moieties. The wing-gap-wing motif is frequently described as "X-Y-Z", where "X" represents the length of the 5' wing, "Y" represents the length of the gap, and "Z" represents the length of the 3' wing. "X" and "Z" may comprise uniform, variant, or alternating sugar moieties. In certain embodiments, "X" and "Y" may include one or more 2'-deoxynucleosides. "Y" may comprise 2'-deoxynucleosides. As used herein, a gapmer described as "X-Y-Z" has a configuration such that the gap is positioned immediately adjacent to each of the 5' wing and the 3' wing. Thus, no intervening nucleotides exist between the 5' wing and gap, or the gap and the 3' wing. Any of the antisense compounds described herein can have a gapmer motif. In certain embodiments, "X" and "Z" are the same; in other embodiments they are different.

In certain embodiments, gapmers provided herein include, for example 20-mers having a motif of 5-10-5.

Target Nucleic Acids, Target Regions and Nucleotide Sequences

Nucleotide sequences that encode human plasma prekallikrein (PKK) include, without limitation, the following: GENBANK Accession No. NM_000892.3 (incorporated herein as SEQ ID NO: 1), GENBANK Accession No. DC412984.1 (incorporated herein as SEQ ID NO: 2), GENBANK Accession No. CN265612.1 (incorporated herein as SEQ ID NO: 3), GENBANK Accession No. AK297672.1 (incorporated herein as SEQ ID NO: 4), GENBANK Accession No. DC413312.1 (incorporated herein as SEQ ID NO: 5), GENBANK Accession No. AV688858.2 (incorporated herein as SEQ ID NO: 6), GENBANK Accession No. CD652077.1 (incorporated herein as SEQ ID NO: 7), GENBANK Accession No. BC143911.1 (incorporated herein as SEQ ID NO: 8), GENBANK Accession No. CB162532.1 (incorporated herein as SEQ ID NO: 9), GENBANK Accession No. NT_016354.19 truncated from nucleobases 111693001 to 11730000 (incorporated herein as SEQ ID NO: 10), GENBANK Accession No. NM_008455.2 (incorporated herein as SEQ ID NO: 11), GENBANK Accession No. BB598673.1 (incorporated herein as SEQ ID NO: 12), GENBANK Accession No. NT_039460.7 truncated from nucleobases 6114001 to 6144000 (incorporated herein as SEQ ID NO: 13), GENBANK Accession No. NM_012725.2 (incorporated herein as SEQ ID NO: 14), GENBANK Accession No. NW_047473.1 truncated from nucleobases 10952001 to 10982000 (incorporated herein as SEQ ID NO: 15), GENBANK Accession No. XM_002804276.1 (incorporated herein as SEQ ID NO: 17), and GENBANK Accession No. NW_001118167.1 truncated from nucleobases 2358000 to 2391000 (incorporated herein as SEQ ID NO: 18).

It is understood that the sequence set forth in each SEQ ID NO in the Examples contained herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase. Antisense compounds described by Isis Number (Isis No) indicate a combination of nucleobase sequence and motif.

In certain embodiments, a target region is a structurally defined region of the target nucleic acid. For example, a target region may encompass a 3' UTR, a 5' UTR, an exon, an intron, an exon/intron junction, a coding region, a translation initiation region, translation termination region, or other defined nucleic acid region. The structurally defined regions for PKK can be obtained by accession number from sequence databases such as NCBI and such information is incorporated herein by reference. In certain embodiments, a target region may encompass the sequence from a 5' target site of one target segment within the target region to a 3' target site of another target segment within the same target region.

Targeting includes determination of at least one target segment to which an antisense compound hybridizes, such that a desired effect occurs. In certain embodiments, the desired effect is a reduction in mRNA target nucleic acid levels. In certain embodiments, the desired effect is reduction of levels of protein encoded by the target nucleic acid or a phenotypic change associated with the target nucleic acid.

A target region may contain one or more target segments. Multiple target segments within a target region may be overlapping. Alternatively, they may be non-overlapping. In certain embodiments, target segments within a target region are separated by no more than about 300 nucleotides. In certain embodiments, target segments within a target region are separated by a number of nucleotides that is, is about, is no more than, is no more than about, 250, 200, 150, 100, 90, 80, 70, 60, 50, 40, 30, 20, or 10 nucleotides on the target nucleic acid, or is a range defined by any two of the preceeding values. In certain embodiments, target segments within a target region are separated by no more than, or no more than about, 5 nucleotides on the target nucleic acid. In certain embodiments, target segments are contiguous. Contemplated are target regions defined by a range having a starting nucleic acid that is any of the 5' target sites or 3' target sites listed herein.

Suitable target segments may be found within a 5' UTR, a coding region, a 3' UTR, an intron, an exon, or an exon/intron junction. Target segments containing a start codon or a stop codon are also suitable target segments. A suitable target segment may specifically exclude a certain structurally defined region such as the start codon or stop codon.

The determination of suitable target segments may include a comparison of the sequence of a target nucleic acid to other sequences throughout the genome. For example, the BLAST algorithm may be used to identify regions of similarity amongst different nucleic acids. This comparison can prevent the selection of antisense compound sequences that may hybridize in a non-specific manner to sequences other than a selected target nucleic acid (i.e., non-target or off-target sequences).

There may be variation in activity (e.g., as defined by percent reduction of target nucleic acid levels) of the antisense compounds within an active target region. In certain embodiments, reductions in PKK mRNA levels are indicative of inhibition of PKK expression. Reductions in levels of a PKK protein are also indicative of inhibition of target mRNA expression. Further, phenotypic changes are indicative of inhibition of PKK expression. For example, reduced or prevented inflammation can be indicative of inhibition of PKK expression. In another example, reduced or prevented edema/swelling can be indicative of inhibition of PKK expression. In another example, reduced or prevented vascular permeability can be indicative of inhibition of PKK expression. In another example, reduced or prevented vascular leakage can be indicative of inhibition of PKK expression. In certain embodiments, vascular permeability is measured by quantification of a dye, such as Evans Blue.

Hybridization

In some embodiments, hybridization occurs between an antisense compound disclosed herein and a target nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with a target nucleic acid.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a PKK nucleic acid).

Non-complementary nucleobases between an antisense compound and a PKK nucleic acid may be tolerated provided that the antisense compound remains able to specifically hybridize to a target nucleic acid. Moreover, an antisense compound may hybridize over one or more segments of a PKK nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 80%, 81%, 82%, 83%, 84%, 85%, 86%, 87%, 88%, 89%, 90%, 91%, 92%, 93%, 94%, 95%, 96%, 97%, 98%, 99%, or 100% complementary to an PKK nucleic acid, a target region, target segment, or specified portion thereof. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having four non-complementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound may be fully complementary to a plasma prekallikrein nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound may or may not be fully complementary to the target sequence, depending on whether the remaining 10 nucleobases of the antisense compound are also complementary to the target sequence.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e. linked) or non-contiguous. In one embodiment, a non-complementary nucleobase is located in the wing segment of a gapmer antisense oligonucleotide.

In certain embodiments, antisense compounds that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid or specified portion thereof.

In certain embodiments, antisense compounds that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid or specified portion thereof.

The antisense compounds provided also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 9 nucleobase portion of a target segment. In certain embodiments, the antisense compounds are complementary to at least a 10 nucleobase portion of a target segment. In certain embodiments, the antisense compounds are complementary to at least an 11 nucleobase portion of a target segment. In certain embodiments, the antisense compounds are complementary to at least a 12 nucleobase portion of a target segment. In certain embodiments, the antisense compounds are complementary to at least a 13 nucleobase portion of a target segment. In certain embodiments, the antisense compounds are complementary to at least a 14 nucleobase portion of a target segment. In certain embodiments, the antisense compounds are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

Identity

The antisense compounds provided herein may also have a defined percent identity to a particular nucleotide sequence, SEQ ID NO, or compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, 75%, 80%, 85%, 90%, 95%, 96%, 97%, 98%, 99% or 100% identical to one or more of the antisense compounds or SEQ ID NOs, or a portion thereof, disclosed herein.

In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, a portion of the antisense oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2',3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a plasma prekallikrein nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides of the present invention comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosphonate linkages. In certain embodiments, oligonucleotides having a gapmer nucleoside motif comprise a linkage motif comprising all phosphorothioate linkages except for one or two methylphosphonate linkages. In certain embodiments, one methylphosphonate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

Modified Sugar Moieties

Antisense compounds can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise chemically modified ribofuranose ring moieties. Examples of chemically modified ribofuranose rings include without limitation, addition of substitutent groups (including 5' and 2' substituent groups, bridging of non-geminal ring atoms to form bicyclic nucleic acids (BNA), replacement of the ribosyl ring oxygen atom with S, N(R), or $C(R_1)(R_2)$ (R, $R_1$ and $R_2$ are each independently H, $C_1$-$C_{12}$ alkyl or a protecting group) and combinations thereof. Examples of chemically modified sugars include 2'-F-5'-methyl substituted nucleoside (see PCT International Application WO 2008/101157 Published on Aug. 21, 2008 for other disclosed 5',2'-bis substituted nucleosides) or replacement of the ribosyl ring oxygen atom with S with further substitution at the 2'-position (see published U.S. Patent Application US2005-0130923, published on Jun. 16, 2005) or alternatively 5'-substitution of a BNA (see PCT International Application WO 2007/134181 Published on Nov. 22, 2007 wherein LNA is substituted with for example a 5'-methyl or a 5'-vinyl group).

Examples of nucleosides having modified sugar moieties include without limitation nucleosides comprising 5'-vinyl, 5'-methyl (R or S), 4'-S, 2'-F, 2'-OCH$_3$, 2'-OCH$_2$CH$_3$, 2'-OCH$_2$CH$_2$F and 2'-O(CH$_2$)$_2$OCH$_3$ substituent groups. The substituent at the 2' position can also be selected from allyl, amino, azido, thio, O-allyl, O—C$_1$-C$_{10}$ alkyl, OCF$_3$, OCH$_2$F, O(CH$_2$)$_2$SCH$_3$, O(CH$_2$)$_2$—O—N(R$_m$)(R$_n$), O—CH$_2$—C(=O)—N(R$_m$)(R$_n$), and O—CH$_2$—C(=O)—N(R$_l$)—(CH$_2$)$_2$—N(R$_m$)(R$_n$), where each R$_l$, R$_m$ and R$_n$ is, independently, H or substituted or unsubstituted C$_1$-C$_{10}$ alkyl.

As used herein, "bicyclic nucleosides" refer to modified nucleosides comprising a bicyclic sugar moiety. Examples of bicyclic nucleosides include without limitation nucleosides comprising a bridge between the 4' and the 2' ribosyl ring atoms. In certain embodiments, antisense compounds provided herein include one or more bicyclic nucleosides comprising a 4' to 2' bridge. Examples of such 4' to 2' bridged bicyclic nucleosides, include but are not limited to one of the formulae: 4'-(CH$_2$)—O-2' (LNA); 4'-(CH$_2$)—S-2'; 4'-(CH$_2$)$_2$—O-2' (ENA); 4'-CH(CH$_3$)—O-2' (also referred to as constrained ethyl or cEt) and 4'-CH(CH$_2$OCH$_3$)—O-2' (and analogs thereof see U.S. Pat. No. 7,399,845, issued on Jul. 15, 2008); 4'-C(CH$_3$)(CH$_3$)—O-2' (and analogs thereof see published International Application WO/2009/006478, published Jan. 8, 2009); 4'-CH$_2$—N(OCH$_3$)-2' (and analogs thereof see published International Application WO/2008/150729, published Dec. 11, 2008); 4'-CH$_2$—O—N(CH$_3$)-2' (see published U.S. Patent Application US2004-0171570, published Sep. 2, 2004); 4'-CH$_2$—N(R)—O-2', wherein R is H, C$_1$-C$_{12}$ alkyl, or a protecting group (see U.S. Pat. No. 7,427,672, issued on Sep. 23, 2008); 4'-CH$_2$—C(H)(CH$_3$)-2' (see Zhou et al., *J. Org. Chem.*, 2009, 74, 118-134); and 4'-CH$_2$—C(=CH$_2$)-2' (and analogs thereof see published International Application WO 2008/154401, published on Dec. 8, 2008).

Further reports related to bicyclic nucleosides can also be found in published literature (see for example: Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129(26) 8362-8379; Elayadi et al., *Curr. Opinion Invest. Drugs*, 2001, 2, 558-561; Braasch et al., *Chem. Biol.*, 2001, 8, 1-7; and Orum et al., *Curr. Opinion Mol. Ther.*, 2001, 3, 239-243; U.S. Pat. Nos. 6,268,490; 6,525,191; 6,670,461; 6,770,748; 6,794,499; 7,034,133; 7,053,207; 7,399,845; 7,547,684; and 7,696,345; U.S. Patent Publication No. US2008-0039618; US2009-0012281; U.S. Patent Serial Nos. 61/026,995 and 61/097,787; Published PCT International applications WO 1999/014226; WO 2004/106356; WO 2005/021570; WO 2007/134181; WO 2008/150729; WO 2008/154401; WO 2009/006478; WO 2010/036698; WO 2011/017521; WO 2009/067647; WO 2009/100320. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

In certain embodiments, bicyclic sugar moieties of BNA nucleosides include, but are not limited to, compounds having at least one bridge between the 4' and the 2' position of the pentofuranosyl sugar moiety wherein such bridges independently comprises 1 or from 2 to 4 linked groups independently selected from —[C(R$_a$)(R$_b$)]$_n$—, —C(R$_a$)=C(R$_b$)—, —C(R$_a$)=N—, —C(=O)—, —C(=NR$_a$)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

In certain embodiments, the bridge of a bicyclic sugar moiety is —[C(R$_a$)(R$_b$)]$_n$—, —[C(R$_a$)(R$_b$)]$_n$—O—, —C(R$_a$R$_b$)—N(R)—O— or —C(R$_a$R$_b$)—O—N(R)—. In certain embodiments, the bridge is 4'-CH$_2$-2', 4'-(CH$_2$)$_2$-2', 4'-(CH$_2$)$_3$-2', 4'-CH$_2$—O-2', 4'-(CH$_2$)$_2$—O-2', 4'-CH$_2$—O—N(R)-2' and 4'-CH$_2$—N(R)—O-2'- wherein each R is, independently, H, a protecting group or C$_1$-C$_{12}$ alkyl.

In certain embodiments, bicyclic nucleosides are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O-2') BNA's have been incorporated into antisense oligonucleotides that showed antisense activity (Frieden et al., *Nucleic Acids Research*, 2003, 21, 6365-6372).

In certain embodiments, bicyclic nucleosides include, but are not limited to, (A) α-L-methyleneoxy (4'-CH$_2$—O-2') BNA, (B) β-D-methyleneoxy (4'-CH$_2$—O-2') BNA, (C) ethyleneoxy (4'-(CH$_2$)$_2$—O-2') BNA, (D) aminooxy (4'-CH$_2$—O—N(R)-2') BNA, (E) oxyamino (4'-CH$_2$—N(R)—O-2') BNA, and (F) methyl(methyleneoxy) (4'-CH(CH$_3$)—O-2') BNA, (G) methylene-thio (4'-CH$_2$—S-2') BNA, (H) methylene-amino (4'-CH$_2$—N(R)-2') BNA, (I) methyl carbocyclic (4'-CH$_2$—CH(CH$_3$)-2') BNA, (J) propylene carbocyclic (4'-(CH$_2$)$_3$-2') BNA and (K) vinyl BNA as depicted below:

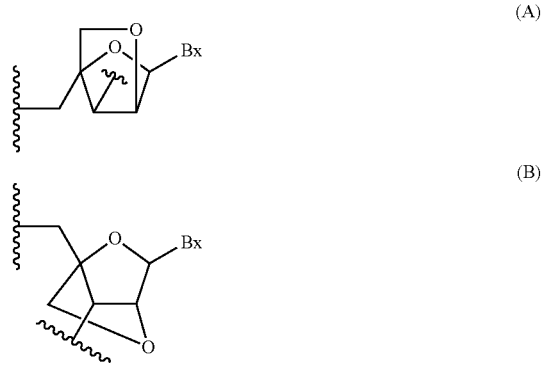

-continued (C) 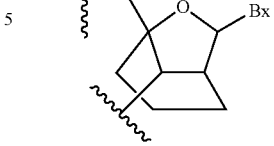

(D) 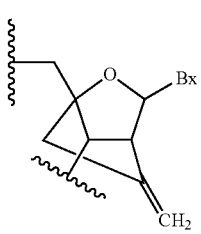

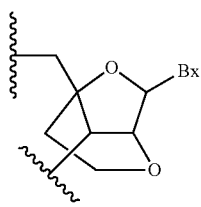

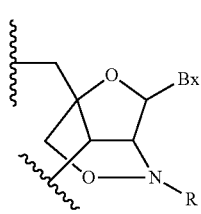

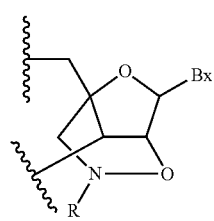

(E)

wherein Bx is the base moiety and R is independently H, a protecting group, $C_1$-$C_{12}$ alkyl or $C_1$-$C_{12}$ alkoxy.

In certain embodiments, bicyclic nucleosides are provided having Formula I:

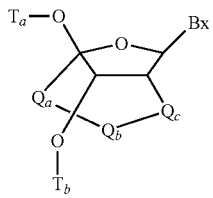

I (F)

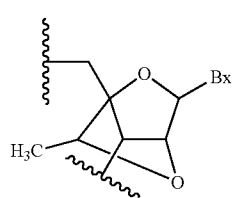

wherein:

Bx is a heterocyclic base moiety;

-$Q_a$-$Q_b$-$Q_c$- is —$CH_2$—$N(R_c)$—$CH_2$—, —$C(=O)$—$N(R_c)$—$CH_2$—, —$CH_2$—$O$—$N(R_c)$—, —$CH_2$—$N(R_c)$—$O$— or —$N(R_c)$—$O$—$CH_2$;

$R_c$ is $C_1$-$C_{12}$ alkyl or an amino protecting group; and $T_a$ and $T_b$ are each, independently H, a hydroxyl protecting group, a conjugate group, a reactive phosphorus group, a phosphorus moiety or a covalent attachment to a support medium.

(G)

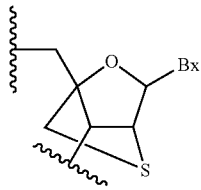

In certain embodiments, bicyclic nucleosides are provided having Formula II:

(H)

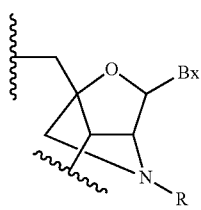

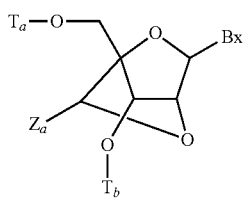

II wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

(I)

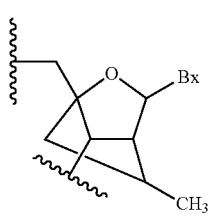

$Z_a$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thio.

In one embodiment, each of the substituted groups is, independently, mono or poly substituted with substituent groups independently selected from halogen, oxo, hydroxyl, $OJ_c$, $NJ_cJ_d$, $SJ_c$, $N_3$, $OC(=X)J_c$, and $NJ_eC(=X)NJ_cJ_d$, wherein each $J_c$, $J_d$ and $J_e$ is, independently, H, $C_1$-$C_6$ alkyl, or substituted $C_1$-$C_6$ alkyl and X is O or $NJ_c$.

In certain embodiments, bicyclic nucleosides are provided having Formula III:

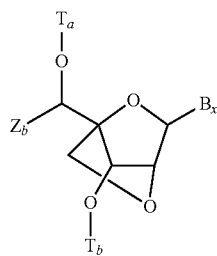

III wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_b$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl or substituted acyl (C(=O)—).

In certain embodiments, bicyclic nucleosides are provided having Formula IV:

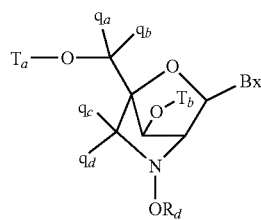

IV wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$R_d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl;

each $q_a$, $q_b$, $q_c$ and $q_d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl or substituted $C_1$-$C_6$ aminoalkyl;

In certain embodiments, bicyclic nucleosides are provided having Formula V:

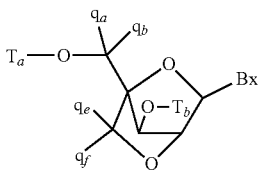

V wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$q_a$, $q_b$, $q_e$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, $C(=O)OJ_j$, $C(=O)NJ_jJ_k$, $C(=O)J_j$, $O-C(=O)NJ_jJ_k$, $N(H)C(=NH)NJ_jJ_k$, $N(H)C(=O)NJ_jJ_k$ or $N(H)C(=S)NJ_jJ_k$;

or $q_e$ and $q_f$ together are $=C(q_g)(q_h)$;

$q_g$ and $q_h$ are each, independently, H, halogen, $C_1$-$C_{12}$ alkyl or substituted $C_1$-$C_{12}$ alkyl.

The synthesis and preparation of the methyleneoxy (4'-$CH_2$—O-2') BNA monomers adenine, cytosine, guanine, 5-methyl-cytosine, thymine and uracil, along with their oligomerization, and nucleic acid recognition properties have been described (Koshkin et al., *Tetrahedron,* 1998, 54, 3607-3630). BNAs and preparation thereof are also described in WO 98/39352 and WO 99/14226.

Analogs of methyleneoxy (4'-$CH_2$—O-2') BNA and 2'-thio-BNAs, have also been prepared (Kumar et al., *Bioorg. Med. Chem. Lett.,* 1998, 8, 2219-2222). Preparation of locked nucleoside analogs comprising oligodeoxyribonucleotide duplexes as substrates for nucleic acid polymerases has also been described (Wengel et al., WO 99/14226). Furthermore, synthesis of 2'-amino-BNA, a novel comformationally restricted high-affinity oligonucleotide analog has been described in the art (Singh et al., *J. Org. Chem.,* 1998, 63, 10035-10039). In addition, 2'-amino- and 2'-methylamino-BNA's have been prepared and the thermal stability of their duplexes with complementary RNA and DNA strands has been previously reported.

In certain embodiments, bicyclic nucleosides are provided having Formula VI:

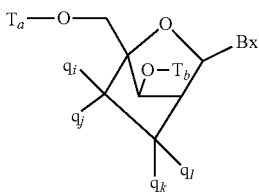

VI wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

each $q_i$, $q_j$, $q_k$ and $q_l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$; and $q_i$ and $q_j$ or $q_l$ and $q_k$ together are =C($q_g$)($q_h$), wherein $q_g$ and $q_h$ are each, independently, H, halogen, $C_1$-$C_{12}$ alkyl or substituted $C_1$-$C_{12}$ alkyl.

One carbocyclic bicyclic nucleoside having a 4'-(CH$_2$)$_3$-2' bridge and the alkenyl analog bridge 4'-CH=CH—CH$_2$-2' have been described (Freier et al., Nucleic Acids Research, 1997, 25(22), 4429-4443 and Albaek et al., J. Org. Chem., 2006, 71, 7731-7740). The synthesis and preparation of carbocyclic bicyclic nucleosides along with their oligomerization and biochemical studies have also been described (Srivastava et al., J. Am. Chem. Soc., 2007, 129(26), 8362-8379).

As used herein, "4'-2' bicyclic nucleoside" or "4' to 2' bicyclic nucleoside" refers to a bicyclic nucleoside comprising a furanose ring comprising a bridge connecting two carbon atoms of the furanose ring connects the 2' carbon atom and the 4' carbon atom of the sugar ring.

As used herein, "monocylic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: O[(CH$_2$)$_n$O]$_m$CH$_3$, O(CH$_2$)$_n$NH$_2$, O(CH$_2$)CH$_3$, O(CH$_2$)$_n$F, O(CH$_2$)$_n$ONH$_2$, OCH$_2$C(=O)N(H)CH$_3$, and O(CH$_2$)$_n$ON[(CH$_2$)$_n$CH$_3$]$_2$, where n and m are from 1 to about 10. Other 2'-substituent groups can also be selected from: $C_1$-$C_{12}$ alkyl, substituted alkyl, alkenyl, alkynyl, alkaryl, aralkyl, O-alkaryl or O-aralkyl, SH, SCH$_3$, OCN, Cl, Br, CN, F, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving pharmacokinetic properties, or a group for improving the pharmacodynamic properties of an antisense compound, and other substituents having similar properties. In certain embodiments, modified nucleosides comprise a 2'-MOE side chain (Baker et al., J. Biol. Chem., 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (Martin, Helv. Chim. Acta, 1995, 78, 486-504; Altmann et al., Chimia, 1996, 50, 168-176; Altmann et al., Biochem. Soc. Trans., 1996, 24, 630-637; and Altmann et al., Nucleosides Nucleotides, 1997, 16, 917-926).

As used herein, a "modified tetrahydropyran nucleoside" or "modified THP nucleoside" means a nucleoside having a six-membered tetrahydropyran "sugar" substituted in for the pentofuranosyl residue in normal nucleosides (a sugar surrogate). Modified THP nucleosides include, but are not limited to, what is referred to in the art as hexitol nucleic acid (HNA), anitol nucleic acid (ANA), manitol nucleic acid (MNA) (see Leumann, Bioorg. Med. Chem., 2002, 10, 841-1954) or fluoro HNA (F-HNA) having a tetrahydropyran ring system as illustrated below:

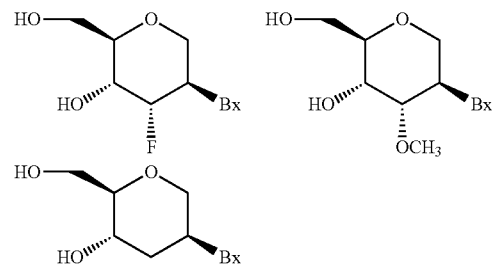

In certain embodiments, sugar surrogates are selected having Formula VII:

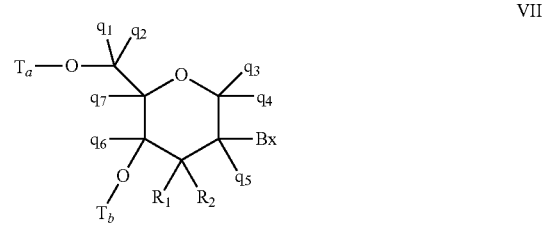

VII wherein independently for each of said at least one tetrahydropyran nucleoside analog of Formula VII:

Bx is a heterocyclic base moiety;

$T_a$ and $T_b$ are each, independently, an internucleoside linking group linking the tetrahydropyran nucleoside analog to the antisense compound or one of $T_a$ and $T_b$ is an internucleoside linking group linking the tetrahydropyran nucleoside analog to the antisense compound and the other of $T_a$ and $T_b$ is H, a hydroxyl protecting group, a linked conjugate group or a 5' or 3'-terminal group;

$q_1$, $q_2$, $q_3$, $q_4$, $q_5$, $q_6$ and $q_7$ are each independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl; and each of $R_1$ and $R_2$ is selected from hydrogen, hydroxyl, halogen, substituted or unsubstituted alkoxy, $NJ_1J_2$, $SJ_1$, $N_3$, OC(=X)$J_1$, OC(=X)$NJ_1J_2$, $NJ_3$C(=X) $NJ_1J_2$ and CN, wherein X is O, S or $NJ_1$ and each $J_1$, $J_2$ and $J_3$ is, independently, H or $C_1$-$C_6$ alkyl.

In certain embodiments, the modified THP nucleosides of Formula VII are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides of Formula VII are provided wherein one of $R_1$ and $R_2$ is fluoro. In certain embodiments, $R_1$ is fluoro and $R_2$ is H; $R_1$ is methoxy and $R_2$ is H, and $R_1$ is methoxyethoxy and $R_2$ is H.

In certain embodiments, sugar surrogates comprise rings having more than 5 atoms and more than one heteroatom. For example nucleosides comprising morpholino sugar moieties and their use in oligomeric compounds has been reported (see for example: Braasch et al., Biochemistry, 2002, 41, 4503-4510; and U.S. Pat. Nos. 5,698,685; 5,166, 315; 5,185,444; and 5,034,506). As used here, the term "morpholino" means a sugar surrogate having the following formula:

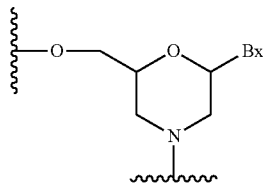

In certain embodiments, morpholinos may be modified, for example by adding or altering various substituent groups from the above morpholino structure. Such sugar surrogates are referred to herein as "modified morpholinos."

Combinations of modifications are also provided without limitation, such as 2'-F-5'-methyl substituted nucleosides (see PCT International Application WO 2008/101157 published on Aug. 21, 2008 for other disclosed 5',2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'-$CH_2$—O-2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., J. Am. Chem. Soc. 2007, 129(26), 8362-8379).

In certain embodiments, antisense compounds comprise one or more modified cyclohexenyl nucleosides, which is a nucleoside having a six-membered cyclohexenyl in place of the pentofuranosyl residue in naturally occurring nucleosides. Modified cyclohexenyl nucleosides include, but are not limited to those described in the art (see for example commonly owned, published PCT Application WO 2010/036696, published on Apr. 10, 2010, Robeyns et al., J. Am. Chem. Soc., 2008, 130(6), 1979-1984; Horvith et al., Tetrahedron Letters, 2007, 48, 3621-3623; Nauwelaerts et al., J. Am. Chem. Soc., 2007, 129(30), 9340-9348; Gu et al., Nucleosides, Nucleotides & Nucleic Acids, 2005, 24(5-7), 993-998; Nauwelaerts et al., Nucleic Acids Research, 2005, 33(8), 2452-2463; Robeyns et al., Acta Crystallographica, Section F: Structural Biology and Crystallization Communications, 2005, F61(6), 585-586; Gu et al., Tetrahedron, 2004, 60(9), 2111-2123; Gu et al., Oligonucleotides, 2003, 13(6), 479-489; Wang et al., J. Org. Chem., 2003, 68, 4499-4505; Verbeure et al., Nucleic Acids Research, 2001, 29(24), 4941-4947; Wang et al., J. Org. Chem., 2001, 66, 8478-82; Wang et al., Nucleosides, Nucleotides & Nucleic Acids, 2001, 20(4-7), 785-788; Wang et al., J. Am. Chem., 2000, 122, 8595-8602; Published PCT application, WO 06/047842; and Published PCT Application WO 01/049687; the text of each is incorporated by reference herein, in their entirety). Certain modified cyclohexenyl nucleosides have Formula X.

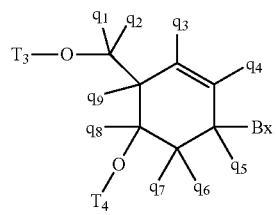

wherein independently for each of said at least one cyclohexenyl nucleoside analog of Formula X:

Bx is a heterocyclic base moiety;

$T_3$ and $T_4$ are each, independently, an internucleoside linking group linking the cyclohexenyl nucleoside analog to an antisense compound or one of $T_3$ and $T_4$ is an internucleoside linking group linking the tetrahydropyran nucleoside analog to an antisense compound and the other of $T_3$ and $T_4$ is H, a hydroxyl protecting group, a linked conjugate group, or a 5'- or 3'-terminal group; and $q_1$, $q_2$, $q_3$, $q_4$, $q_5$, $q_6$, $q_7$, $q_8$ and $q_9$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or other sugar substituent group.

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring; and nucleosides with non-bridging 2' substituents, such as allyl, amino, azido, thio, O-allyl, O—$C_1$-$C_{10}$ alkyl, —$OCF_3$, O—$(CH_2)_2$—O—$CH_3$, 2'-O$(CH_2)_2SCH_3$, O—$(CH_2)_2$—O—N($R_m$)($R_n$), or O—$CH_2$—C(=O)—N($R_m$)($R_n$), where each $R_m$ and R, is, independently, H or substituted or unsubstituted $C_1$-$C_{10}$ alkyl. 2'-modified nucleosides may further comprise other modifications, for example at other positions of the sugar and/or at the nucleobase.

As used herein, "2'-F" refers to a nucleoside comprising a sugar comprising a fluoro group at the 2' position of the sugar ring.

As used herein, "2'-OMe" or "2'-$OCH_3$" or "2'-O-methyl" each refers to a nucleoside comprising a sugar comprising an —$OCH_3$ group at the 2' position of the sugar ring.

As used herein, "MOE" or "2'-MOE" or "2'-$OCH_2CH_2OCH_3$" or "2'-O-methoxyethyl" each refers to a nucleoside comprising a sugar comprising a —$OCH_2CH_2OCH_3$ group at the 2' position of the sugar ring.

As used herein, "oligonucleotide" refers to a compound comprising a plurality of linked nucleosides. In certain embodiments, one or more of the plurality of nucleosides is modified. In certain embodiments, an oligonucleotide comprises one or more ribonucleosides (RNA) and/or deoxyribonucleosides (DNA).

Many other bicyclo and tricyclo sugar surrogate ring systems are also known in the art that can be used to modify nucleosides for incorporation into antisense compounds (see for example review article: Leumann, Bioorg. Med. Chem., 2002, 10, 841-1954). Such ring systems can undergo various additional substitutions to enhance activity.

Methods for the preparations of modified sugars are well known to those skilled in the art. Some representative U.S. patents that teach the preparation of such modified sugars include without limitation, U.S. Pat. Nos. 4,981,957; 5,118, 800; 5,319,080; 5,359,044; 5,393,878; 5,446,137; 5,466, 786; 5,514,785; 5,519,134; 5,567,811; 5,576,427; 5,591,722; 5,597,909; 5,610,300; 5,627,053; 5,639,873; 5,646,265; 5,670,633; 5,700,920; 5,792,847 and 6,600,032 and International Application PCT/US2005/019219, filed Jun. 2, 2005 and published as WO 2005/121371 on Dec. 22, 2005, and each of which is herein incorporated by reference in its entirety.

In nucleotides having modified sugar moieties, the nucleobase moieties (natural, modified or a combination thereof) are maintained for hybridization with an appropriate nucleic acid target.

In certain embodiments, antisense compounds comprise one or more nucleosides having modified sugar moieties. In certain embodiments, the modified sugar moiety is 2'-MOE. In certain embodiments, the 2'-MOE modified nucleosides are arranged in a gapmer motif. In certain embodiments, the modified sugar moiety is a bicyclic nucleoside having a (4'-CH(CH$_3$)—O-2') bridging group. In certain embodiments, the (4'-CH(CH$_3$)—O-2') modified nucleosides are arranged throughout the wings of a gapmer motif.

Conjugated Antisense Compounds

In certain embodiments, the present disclosure provides conjugated antisense compounds. In certain embodiments, the present disclosure provides conjugated antisense compounds comprising an antisense oligonucleotide complementary to a nucleic acid transcript. In certain embodiments, the present disclosure provides methods comprising contacting a cell with a conjugated antisense compound comprising an antisense oligonucleotide complementary to a nucleic acid transcript. In certain embodiments, the present disclosure provides methods comprising contacting a cell with a conjugated antisense compound comprising an antisense oligonucleotide and reducing the amount or activity of a nucleic acid transcript in a cell.

The asialoglycoprotein receptor (ASGP-R) has been described previously. See e.g., Park et al., PNAS vol. 102, No. 47, pp 17125-17129 (2005). Such receptors are expressed on liver cells, particularly hepatocytes. Further, it has been shown that compounds comprising clusters of three N-acetylgalactosamine (GalNAc) ligands are capable of binding to the ASGP-R, resulting in uptake of the compound into the cell. See e.g., Khorev et al., Bioorganic and Medicinal Chemistry, 16, 9, pp 5216-5231 (May 2008). Accordingly, conjugates comprising such GalNAc clusters have been used to facilitate uptake of certain compounds into liver cells, specifically hepatocytes. For example it has been shown that certain GalNAc-containing conjugates increase activity of duplex siRNA compounds in liver cells in vivo. In such instances, the GalNAc-containing conjugate is typically attached to the sense strand of the siRNA duplex. Since the sense strand is discarded before the antisense strand ultimately hybridizes with the target nucleic acid, there is little concern that the conjugate will interfere with activity. Typically, the conjugate is attached to the 3' end of the sense strand of the siRNA. See e.g., U.S. Pat. No. 8,106,022. Certain conjugate groups described herein are more active and/or easier to synthesize than conjugate groups previously described.

In certain embodiments of the present invention, conjugates are attached to single-stranded antisense compounds, including, but not limited to RNase H based antisense compounds and antisense compounds that alter splicing of a pre-mRNA target nucleic acid. In such embodiments, the conjugate should remain attached to the antisense compound long enough to provide benefit (improved uptake into cells) but then should either be cleaved, or otherwise not interfere with the subsequent steps necessary for activity, such as hybridization to a target nucleic acid and interaction with RNase H or enzymes associated with splicing or splice modulation. This balance of properties is more important in the setting of single-stranded antisense compounds than in siRNA compounds, where the conjugate may simply be attached to the sense strand. Disclosed herein are conjugated single-stranded antisense compounds having improved potency in liver cells in vivo compared with the same antisense compound lacking the conjugate. Given the required balance of properties for these compounds such improved potency is surprising.

In certain embodiments, conjugate groups herein comprise a cleavable moiety. As noted, without wishing to be bound by mechanism, it is logical that the conjugate should remain on the compound long enough to provide enhancement in uptake, but after that, it is desirable for some portion or, ideally, all of the conjugate to be cleaved, releasing the parent compound (e.g., antisense compound) in its most active form. In certain embodiments, the cleavable moiety is a cleavable nucleoside. Such embodiments take advantage of endogenous nucleases in the cell by attaching the rest of the conjugate (the cluster) to the antisense oligonucleotide through a nucleoside via one or more cleavable bonds, such as those of a phosphodiester linkage. In certain embodiments, the cluster is bound to the cleavable nucleoside through a phosphodiester linkage. In certain embodiments, the cleavable nucleoside is attached to the antisense oligonucleotide (antisense compound) by a phosphodiester linkage. In certain embodiments, the conjugate group may comprise two or three cleavable nucleosides. In such embodiments, such cleavable nucleosides are linked to one another, to the antisense compound and/or to the cluster via cleavable bonds (such as those of a phosphodiester linkage). Certain conjugates herein do not comprise a cleavable nucleoside and instead comprise a cleavable bond. It is shown that that sufficient cleavage of the conjugate from the oligonucleotide is provided by at least one bond that is vulnerable to cleavage in the cell (a cleavable bond).

In certain embodiments, conjugated antisense compounds are prodrugs. Such prodrugs are administered to an animal and are ultimately metabolized to a more active form. For example, conjugated antisense compounds are cleaved to remove all or part of the conjugate resulting in the active (or more active) form of the antisense compound lacking all or some of the conjugate.

In certain embodiments, conjugates are attached at the 5' end of an oligonucleotide. Certain such 5'-conjugates are cleaved more efficiently than counterparts having a similar conjugate group attached at the 3' end. In certain embodiments, improved activity may correlate with improved cleavage. In certain embodiments, oligonucleotides comprising a conjugate at the 5' end have greater efficacy than oligonucleotides comprising a conjugate at the 3' end (see, for example, Examples 56, 81, 83, and 84). Further, 5'-attachment allows simpler oligonucleotide synthesis. Typically, oligonucleotides are synthesized on a solid support in the 3' to 5' direction. To make a 3'-conjugated oligonucleotide, typically one attaches a pre-conjugated 3' nucleoside to the solid support and then builds the oligonucleotide as usual. However, attaching that conjugated nucleoside to the solid support adds complication to the synthesis. Further, using that approach, the conjugate is then present throughout the synthesis of the oligonucleotide and can become degraded during subsequent steps or may limit the sorts of reactions and reagents that can be used. Using the structures and techniques described herein for 5'-conjugated oligonucleotides, one can synthesize the oligonucleotide using standard automated techniques and introduce the conjugate with the final (5'-most) nucleoside or after the oligonucleotide has been cleaved from the solid support.

In view of the art and the present disclosure, one of ordinary skill can easily make any of the conjugates and conjugated oligonucleotides herein. Moreover, synthesis of certain such conjugates and conjugated oligonucleotides disclosed herein is easier and/or requires few steps, and is therefore less expensive than that of conjugates previously disclosed, providing advantages in manufacturing. For example, the synthesis of certain conjugate groups consists of fewer synthetic steps, resulting in increased yield, relative to conjugate groups previously described. Conjugate groups such as GalNAc3-10 in Example 46 and GalNAc3-7 in Example 48 are much simpler than previously described conjugates such as those described in U.S. Pat. No. 8,106,022 or U.S. Pat. No. 7,262,177 that require assembly of more chemical intermediates. Accordingly, these and other conjugates described herein have advantages over previously described compounds for use with any oligonucleotide, including single-stranded oligonucleotides and either strand of double-stranded oligonucleotides (e.g., siRNA).

Similarly, disclosed herein are conjugate groups having only one or two GalNAc ligands. As shown, such conjugates groups improve activity of antisense compounds. Such compounds are much easier to prepare than conjugates comprising three GalNAc ligands. Conjugate groups comprising one or two GalNAc ligands may be attached to any antisense compounds, including single-stranded oligonucleotides and either strand of double-stranded oligonucleotides (e.g., siRNA).

In certain embodiments, the conjugates herein do not substantially alter certain measures of tolerability. For example, it is shown herein that conjugated antisense compounds are not more immunogenic than unconjugated parent compounds. Since potency is improved, embodiments in which tolerability remains the same (or indeed even if tolerability worsens only slightly compared to the gains in potency) have improved properties for therapy.

In certain embodiments, conjugation allows one to alter antisense compounds in ways that have less attractive consequences in the absence of conjugation. For example, in certain embodiments, replacing one or more phosphorothioate linkages of a fully phosphorothioate antisense compound with phosphodiester linkages results in improvement in some measures of tolerability. For example, in certain instances, such antisense compounds having one or more phosphodiester are less immunogenic than the same compound in which each linkage is a phosphorothioate. However, in certain instances, as shown in Example 26, that same replacement of one or more phosphorothioate linkages with phosphodiester linkages also results in reduced cellular uptake and/or loss in potency. In certain embodiments, conjugated antisense compounds described herein tolerate such change in linkages with little or no loss in uptake and potency when compared to the conjugated full-phosphorothioate counterpart. In fact, in certain embodiments, for example, in Examples 44, 57, 59, and 86, oligonucleotides comprising a conjugate and at least one phosphodiester internucleoside linkage actually exhibit increased potency in vivo even relative to a full phosphorothioate counterpart also comprising the same conjugate. Moreover, since conjugation results in substantial increases in uptake/potency a small loss in that substantial gain may be acceptable to achieve improved tolerability. Accordingly, in certain embodiments, conjugated antisense compounds comprise at least one phosphodiester linkage.

In certain embodiments, conjugation of antisense compounds herein results in increased delivery, uptake and activity in hepatocytes. Thus, more compound is delivered to liver tissue. However, in certain embodiments, that increased delivery alone does not explain the entire increase in activity. In certain such embodiments, more compound enters hepatocytes. In certain embodiments, even that increased hepatocyte uptake does not explain the entire increase in activity. In such embodiments, productive uptake of the conjugated compound is increased. For example, as shown in Example 102, certain embodiments of GalNAc-containing conjugates increase enrichment of antisense oligonucleotides in hepatocytes versus non-parenchymal cells. This enrichment is beneficial for oligonucleotides that target genes that are expressed in hepatocytes.

In certain embodiments, conjugated antisense compounds herein result in reduced kidney exposure. For example, as shown in Example 20, the concentrations of antisense oligonucleotides comprising certain embodiments of GalNAc-containing conjugates are lower in the kidney than that of antisense oligonucleotides lacking a GalNAc-containing conjugate. This has several beneficial therapeutic implications. For therapeutic indications where activity in the kidney is not sought, exposure to kidney risks kidney toxicity without corresponding benefit. Moreover, high concentration in kidney typically results in loss of compound to the urine resulting in faster clearance. Accordingly for non-kidney targets, kidney accumulation is undesired.

In certain embodiments, the present disclosure provides conjugated antisense compounds represented by the formula:

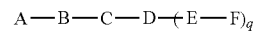

wherein
A is the antisense oligonucleotide;
B is the cleavable moiety
C is the conjugate linker
D is the branching group
each E is a tether;
each F is a ligand; and
q is an integer between 1 and 5.

In the above diagram and in similar diagrams herein, the branching group "D" branches as many times as is necessary to accommodate the number of (E-F) groups as indicated by "q". Thus, where q=1, the formula is:

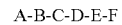

where q=2, the formula is:

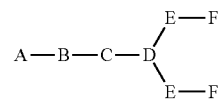

where q=3, the formula is:

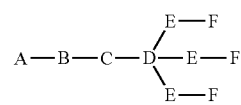

where q=4, the formula is:

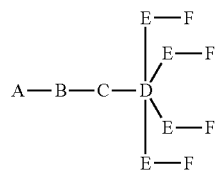
where q=5, the formula is:
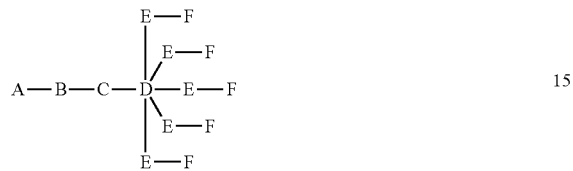
In certain embodiments, conjugated antisense compounds are provided having the structure:

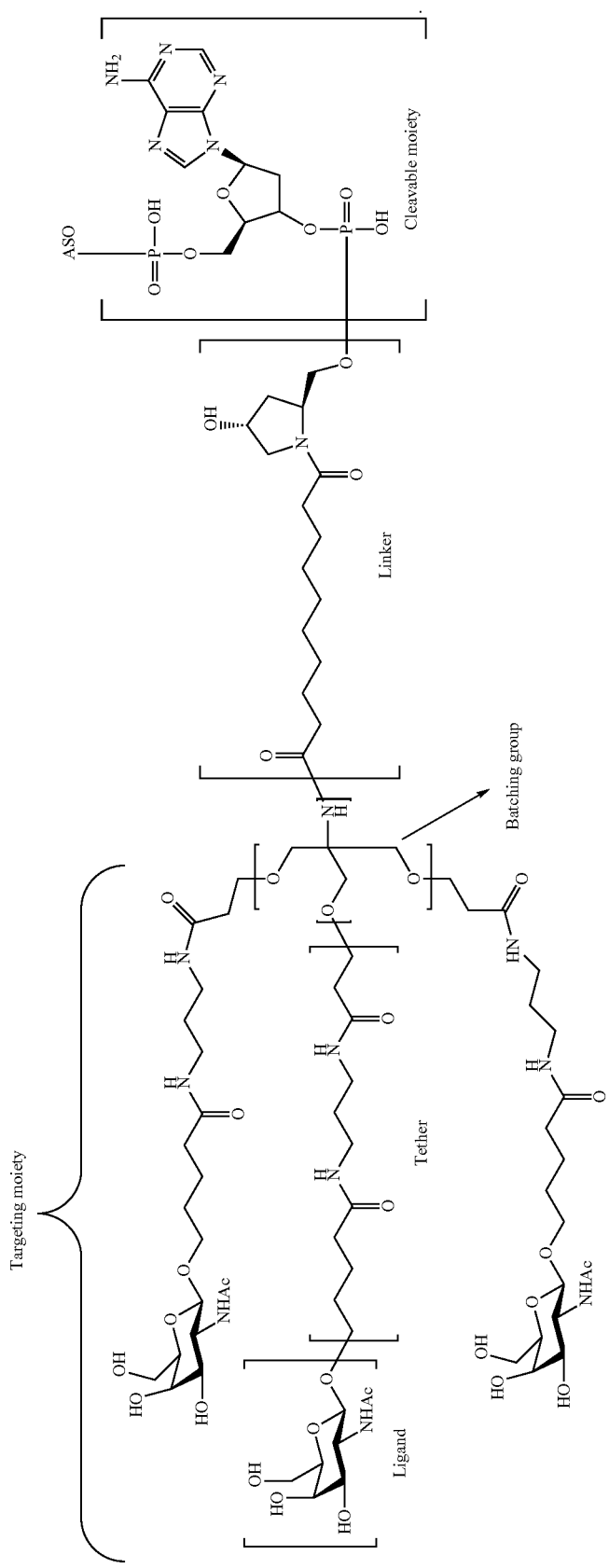

In certain embodiments, conjugated antisense compounds are provided having the structure:
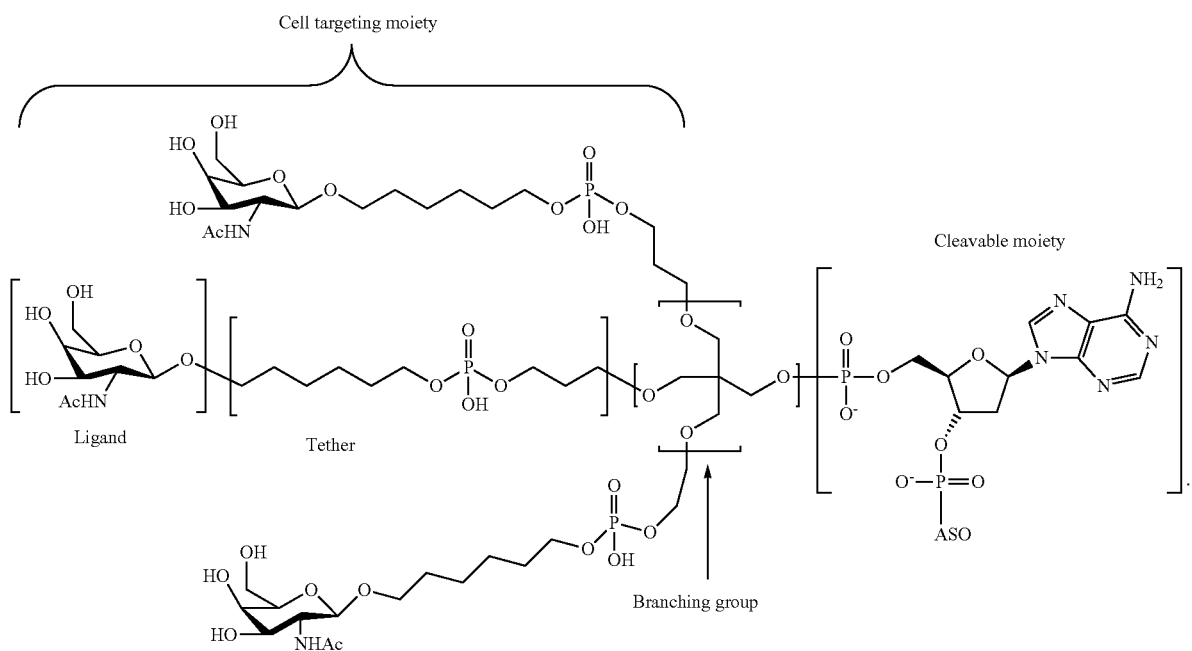
In certain embodiments, conjugated antisense compounds are provided having the structure:
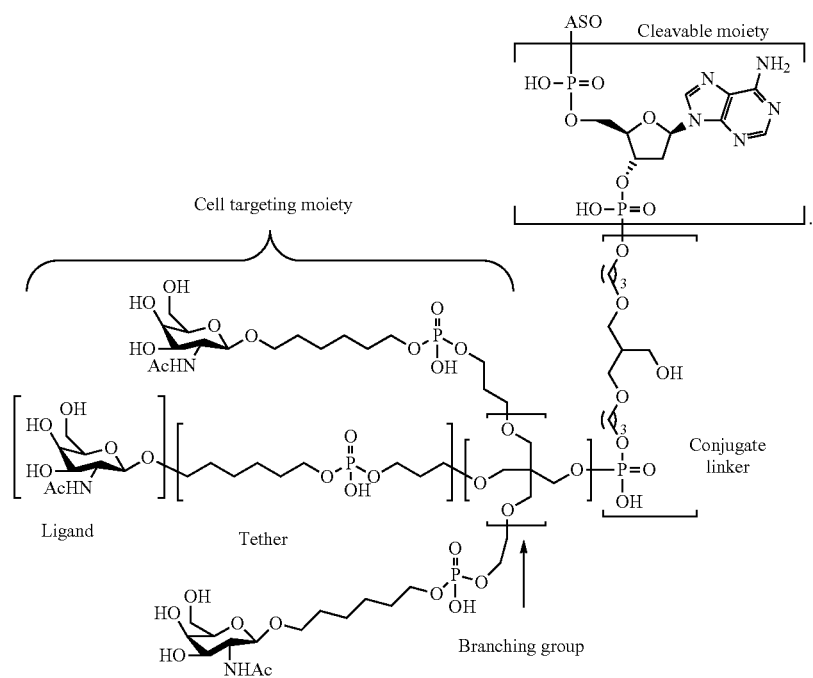

In certain embodiments, conjugated antisense compounds are provided having the structure:

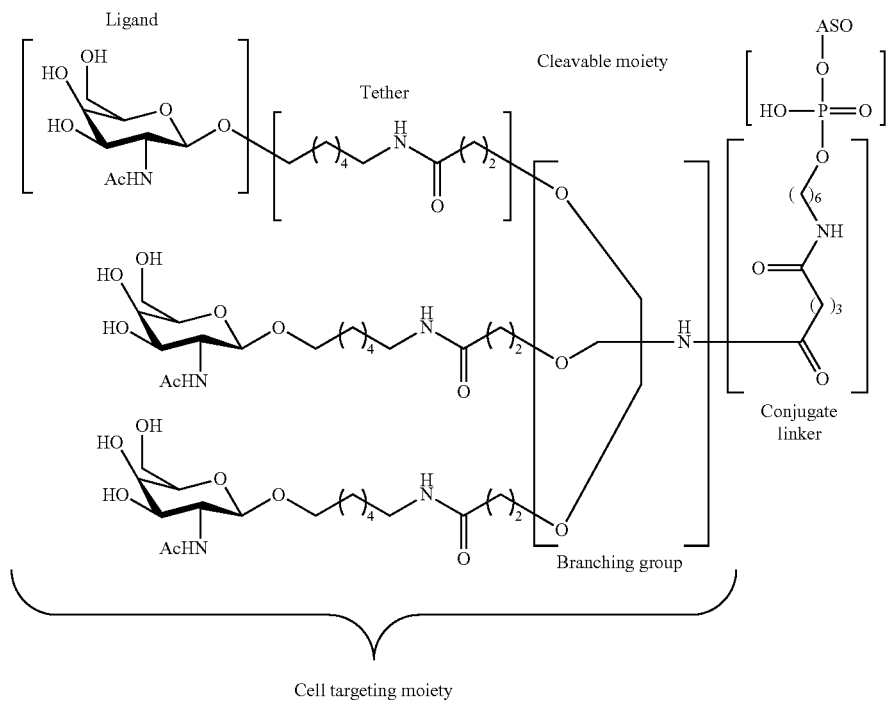

In embodiments having more than one of a particular variable (e.g., more than one "m" or "n"), unless otherwise indicated, each such particular variable is selected independently. Thus, for a structure having more than one n, each n is selected independently, so they may or may not be the same as one another.

i. Certain Cleavable Moieties

In certain embodiments, a cleavable moiety is a cleavable bond. In certain embodiments, a cleavable moiety comprises a cleavable bond. In certain embodiments, the conjugate group comprises a cleavable moiety. In certain such embodiments, the cleavable moiety attaches to the antisense oligonucleotide. In certain such embodiments, the cleavable moiety attaches directly to the cell-targeting moiety. In certain such embodiments, the cleavable moiety attaches to the conjugate linker. In certain embodiments, the cleavable moiety comprises a phosphate or phosphodiester. In certain embodiments, the cleavable moiety is a cleavable nucleoside or nucleoside analog. In certain embodiments, the nucleoside or nucleoside analog comprises an optionally protected heterocyclic base selected from a purine, substituted purine, pyrimidine or substituted pyrimidine. In certain embodiments, the cleavable moiety is a nucleoside comprising an optionally protected heterocyclic base selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. In certain embodiments, the cleavable moiety is 2'-deoxy nucleoside that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester linkage.

In certain embodiments, the cleavable moiety is attached to the 3' position of the antisense oligonucleotide. In certain embodiments, the cleavable moiety is attached to the 5' position of the antisense oligonucleotide. In certain embodiments, the cleavable moiety is attached to a 2' position of the antisense oligonucleotide. In certain embodiments, the cleavable moiety is attached to the antisense oligonucleotide by a phosphodiester linkage. In certain embodiments, the cleavable moiety is attached to the linker by either a phosphodiester or a phosphorothioate linkage. In certain embodiments, the cleavable moiety is attached to the linker by a phosphodiester linkage. In certain embodiments, the conjugate group does not include a cleavable moiety.

In certain embodiments, the cleavable moiety is cleaved after the complex has been administered to an animal only after being internalized by a targeted cell. Inside the cell the cleavable moiety is cleaved thereby releasing the active antisense oligonucleotide. While not wanting to be bound by theory it is believed that the cleavable moiety is cleaved by one or more nucleases within the cell. In certain embodiments, the one or more nucleases cleave the phosphodiester linkage between the cleavable moiety and the linker. In certain embodiments, the cleavable moiety has a structure selected from among the following:

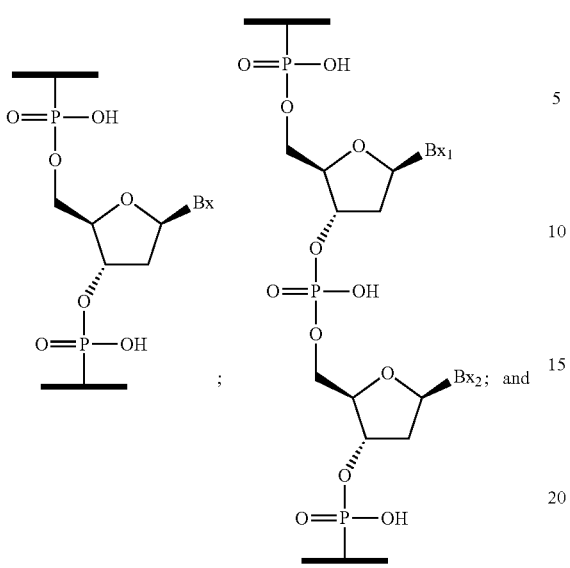
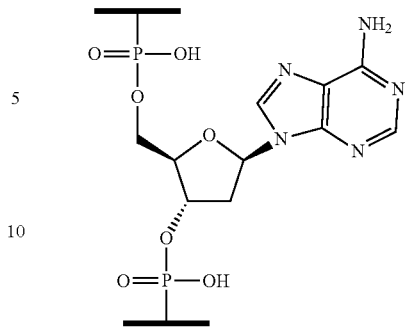
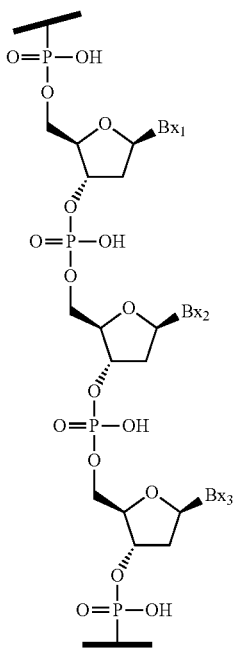

wherein each of Bx, Bx₁, Bx₂, and Bx₃ is independently a heterocyclic base moiety. In certain embodiments, the cleavable moiety has a structure selected from among the following:

ii. Certain Linkers

In certain embodiments, the conjugate groups comprise a linker. In certain such embodiments, the linker is covalently bound to the cleavable moiety. In certain such embodiments, the linker is covalently bound to the antisense oligonucleotide. In certain embodiments, the linker is covalently bound to a cell-targeting moiety. In certain embodiments, the linker further comprises a covalent attachment to a solid support. In certain embodiments, the linker further comprises a covalent attachment to a protein binding moiety. In certain embodiments, the linker further comprises a covalent attachment to a solid support and further comprises a covalent attachment to a protein binding moiety. In certain embodiments, the linker includes multiple positions for attachment of tethered ligands. In certain embodiments, the linker includes multiple positions for attachment of tethered ligands and is not attached to a branching group. In certain embodiments, the linker further comprises one or more cleavable bond. In certain embodiments, the conjugate group does not include a linker.

In certain embodiments, the linker includes at least a linear group comprising groups selected from alkyl, amide, disulfide, polyethylene glycol, ether, thioether (—S—) and hydroxylamino (—O—N(H)—) groups. In certain embodiments, the linear group comprises groups selected from alkyl, amide and ether groups. In certain embodiments, the linear group comprises groups selected from alkyl and ether groups. In certain embodiments, the linear group comprises at least one phosphorus linking group. In certain embodiments, the linear group comprises at least one phosphodiester group. In certain embodiments, the linear group includes at least one neutral linking group. In certain embodiments, the linear group is covalently attached to the cell-targeting moiety and the cleavable moiety. In certain embodiments, the linear group is covalently attached to the cell-targeting moiety and the antisense oligonucleotide. In certain embodiments, the linear group is covalently attached to the cell-targeting moiety, the cleavable moiety and a solid support. In certain embodiments, the linear group is covalently attached to the cell-targeting moiety, the cleavable moiety, a solid support and a protein binding moiety. In certain embodiments, the linear group includes one or more cleavable bond.

In certain embodiments, the linker includes the linear group covalently attached to a scaffold group. In certain embodiments, the scaffold includes a branched aliphatic group comprising groups selected from alkyl, amide, disulfide, polyethylene glycol, ether, thioether and hydroxylamino groups. In certain embodiments, the scaffold includes a branched aliphatic group comprising groups selected from alkyl, amide and ether groups. In certain embodiments, the scaffold includes at least one mono or polycyclic ring system. In certain embodiments, the scaffold includes at least two mono or polycyclic ring systems. In certain embodiments, the linear group is covalently attached to the scaffold group and the scaffold group is covalently attached to the cleavable moiety and the linker. In certain embodiments, the linear group is covalently attached to the scaffold group and the scaffold group is covalently attached to the cleavable moiety, the linker and a solid support. In certain embodiments, the linear group is covalently attached to the scaffold group and the scaffold group is covalently attached to the cleavable moiety, the linker and a protein binding moiety. In certain embodiments, the linear group is covalently attached to the scaffold group and the scaffold group is covalently attached to the cleavable moiety, the linker, a protein binding moiety and a solid support. In certain embodiments, the scaffold group includes one or more cleavable bond.

In certain embodiments, the linker includes a protein binding moiety. In certain embodiments, the protein binding moiety is a lipid such as for example including but not limited to cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid. In certain embodiments, the protein binding moiety is a C16 to C22 long chain saturated or unsaturated fatty acid, cholesterol, cholic acid, vitamin E, adamantane or 1-pentafluoropropyl.

In certain embodiments, a linker has a structure selected from among:

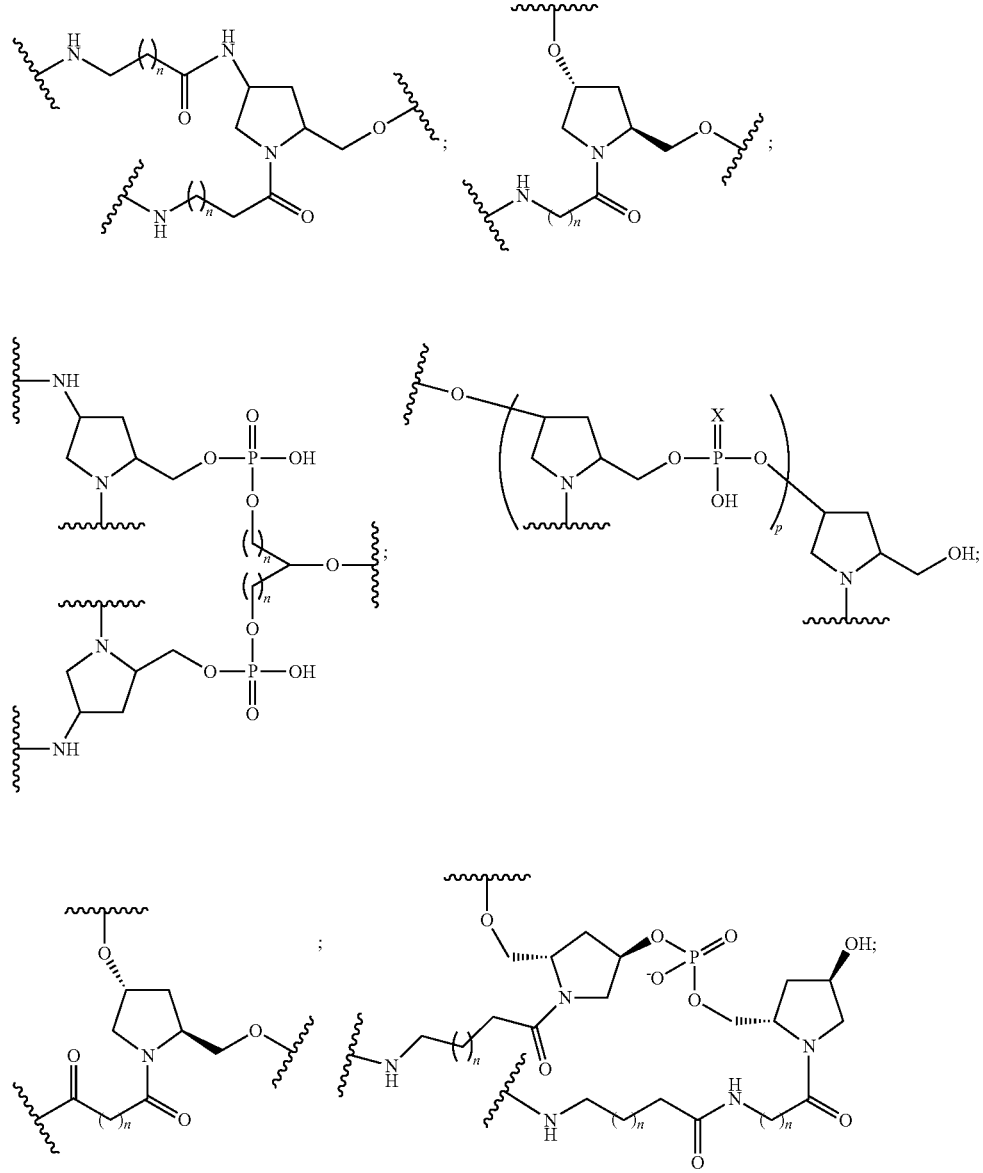

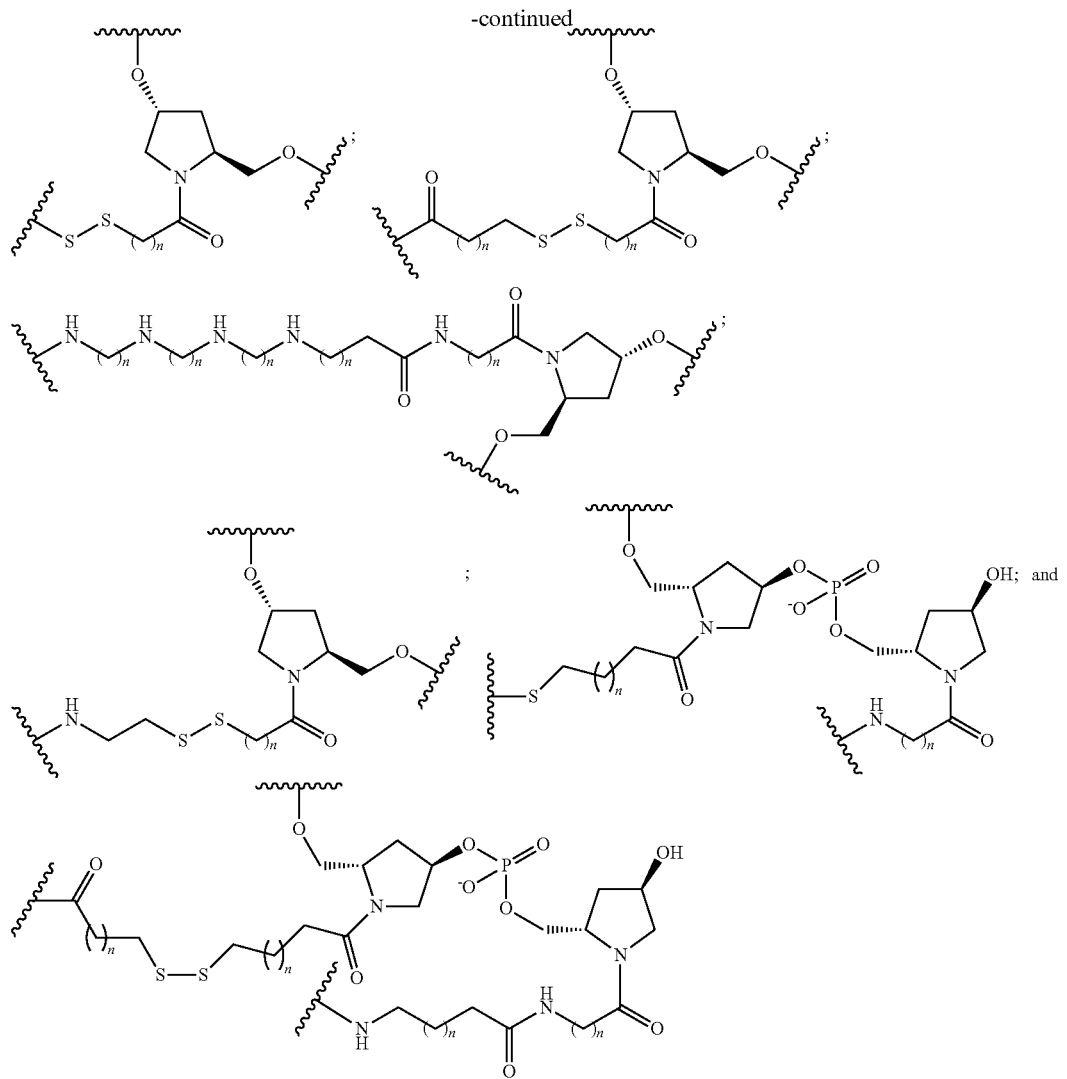
wherein each n is, independently, from 1 to 20; and p is from 1 to 6.
In certain embodiments, a linker has a structure selected from among:
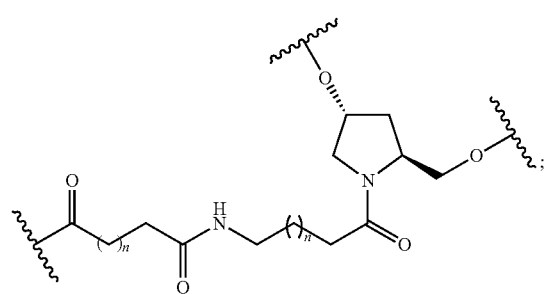

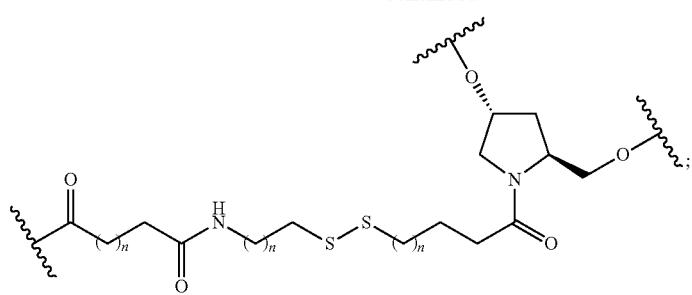
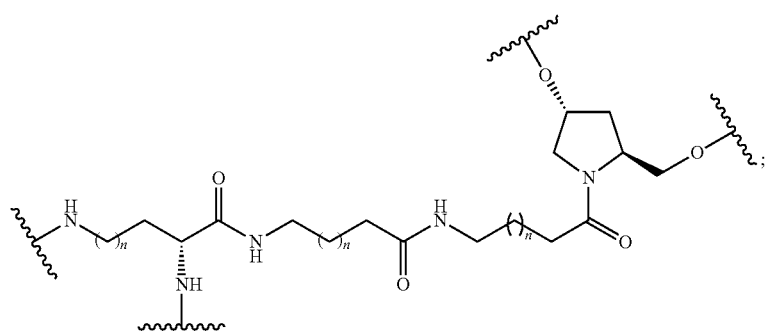
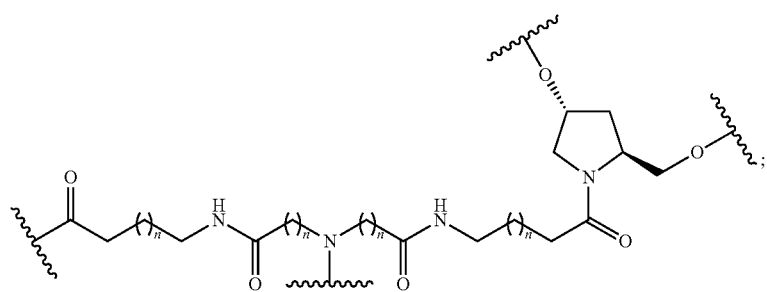
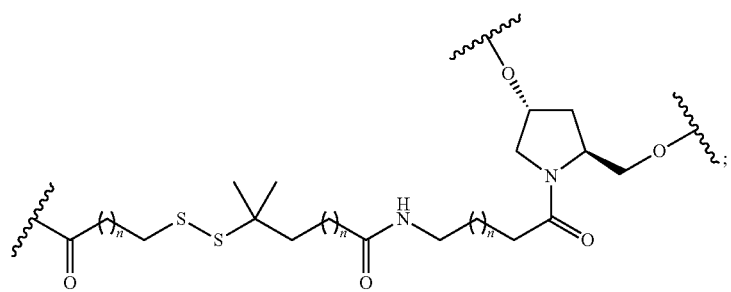
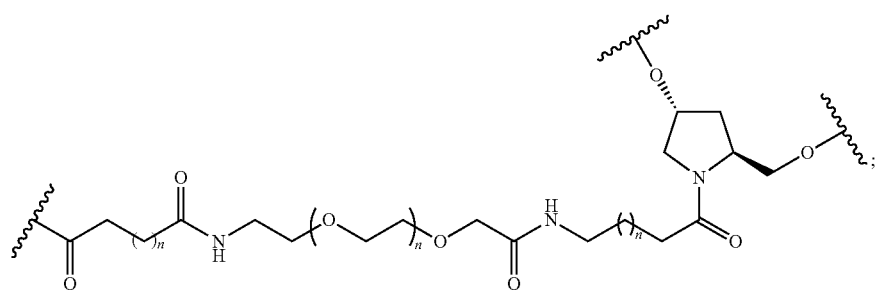

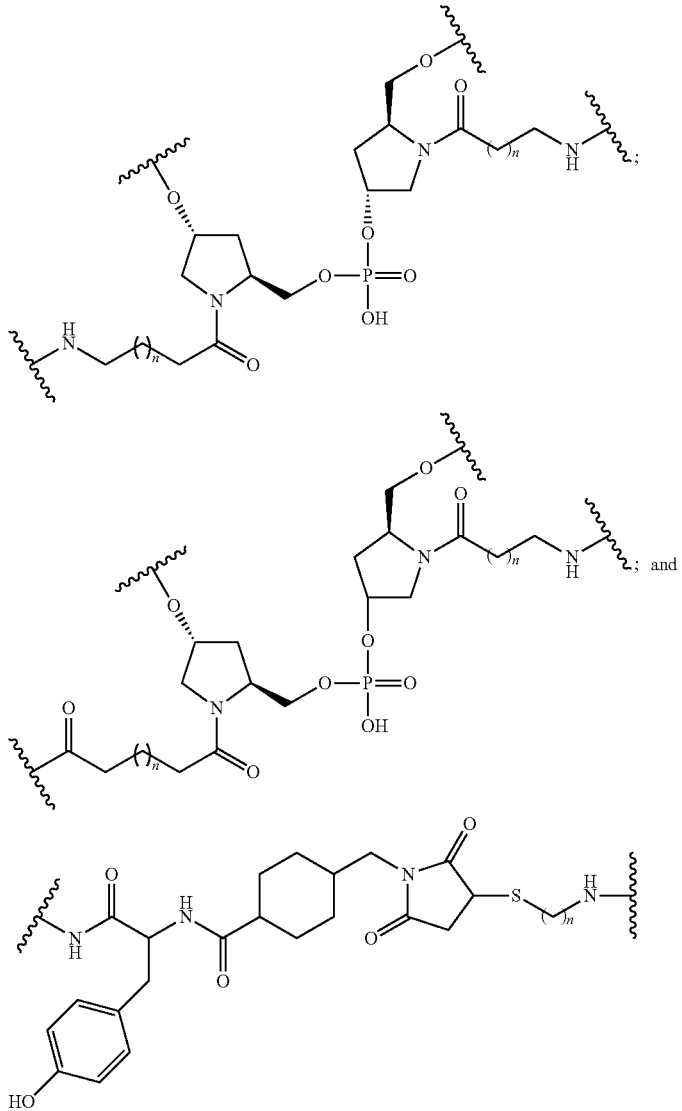
wherein each n is, independently, from 1 to 20.
In certain embodiments, a linker has a structure selected from among:
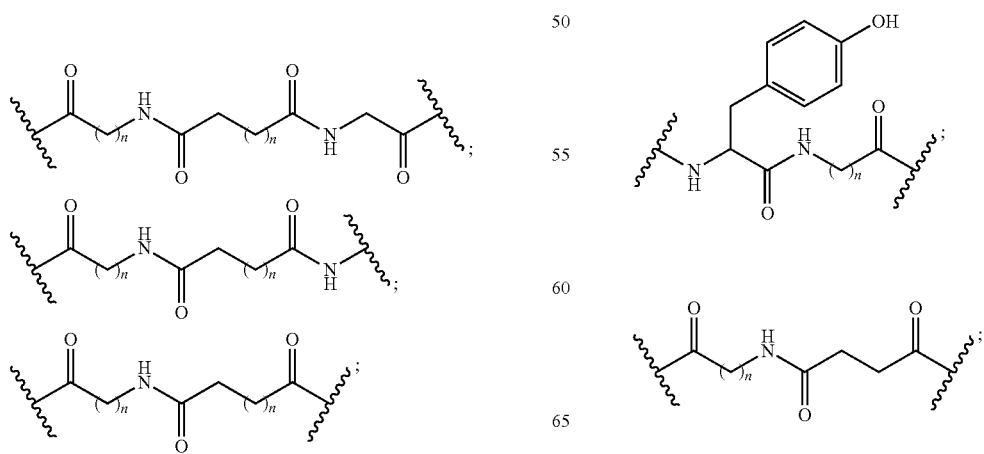

-continued
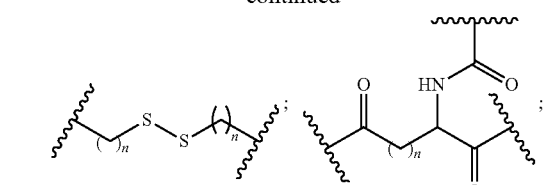
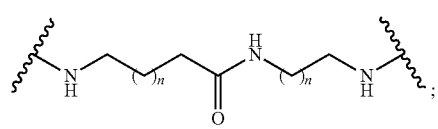
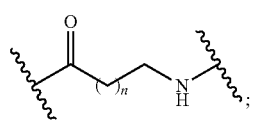
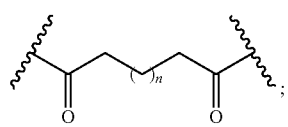
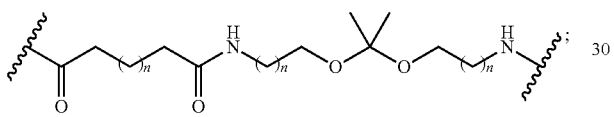
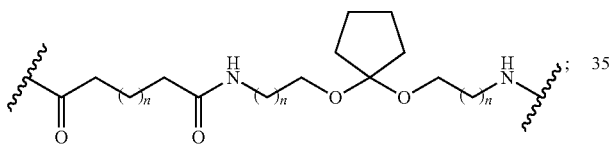
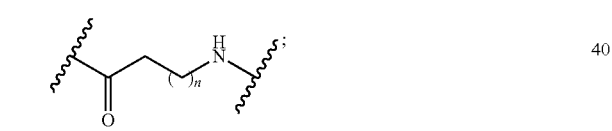
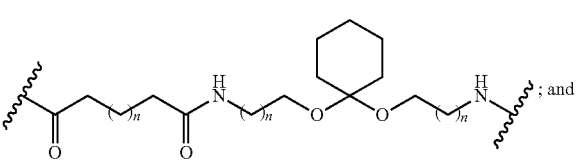
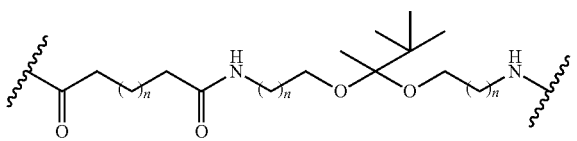
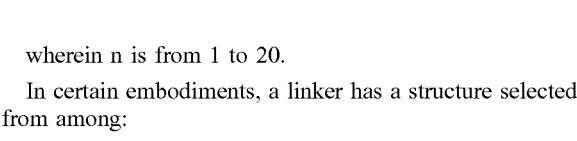 ; and
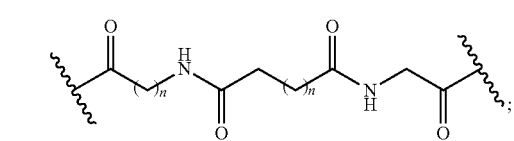
wherein n is from 1 to 20.
In certain embodiments, a linker has a structure selected from among:
-continued
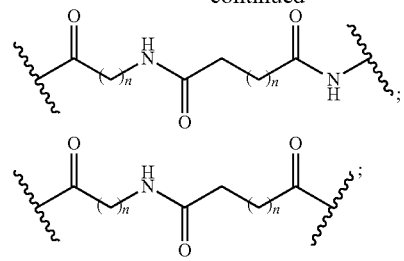
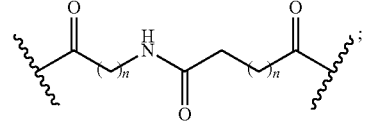
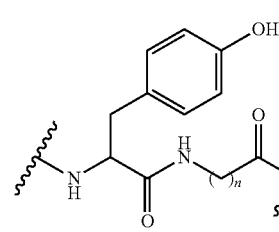
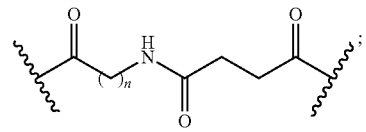
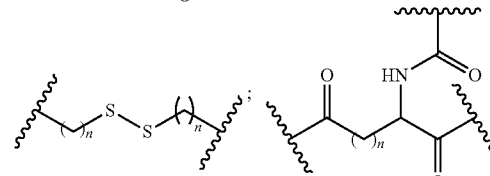
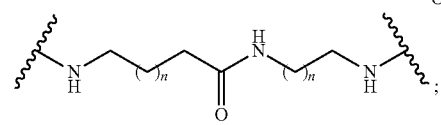
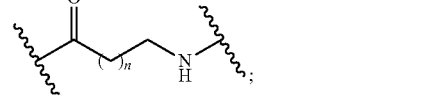
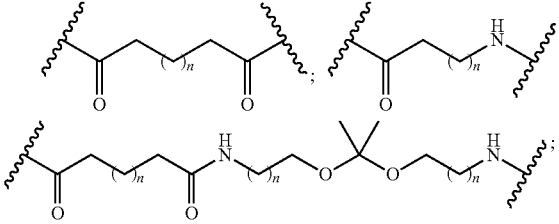
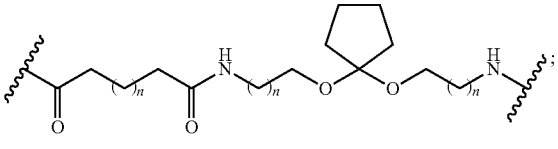
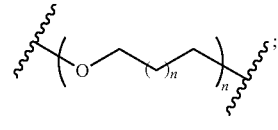
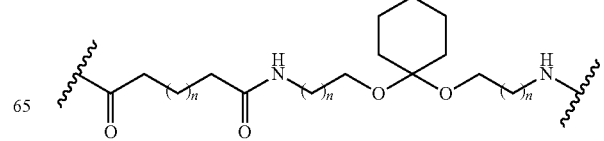

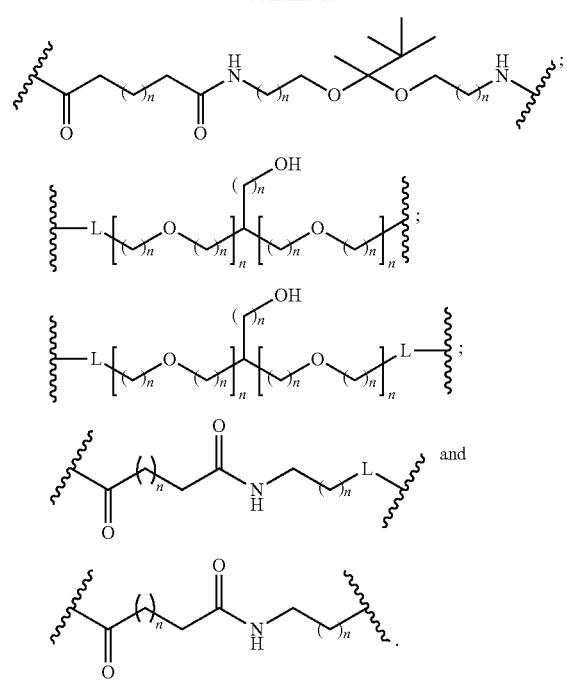
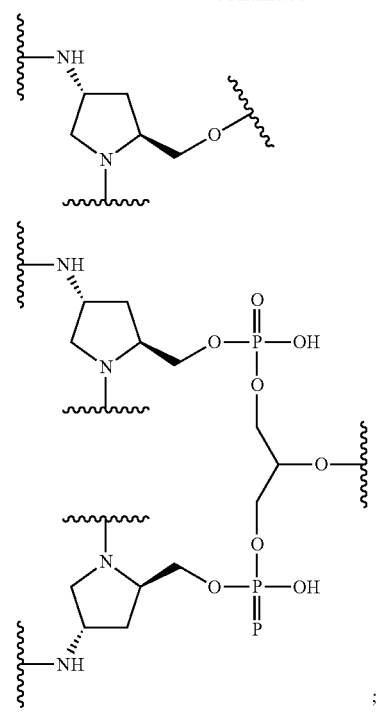
wherein each L is, independently, a phosphorus linking group or a neutral linking group; and
each n is, independently, from 1 to 20.
In certain embodiments, a linker has a structure selected from among:
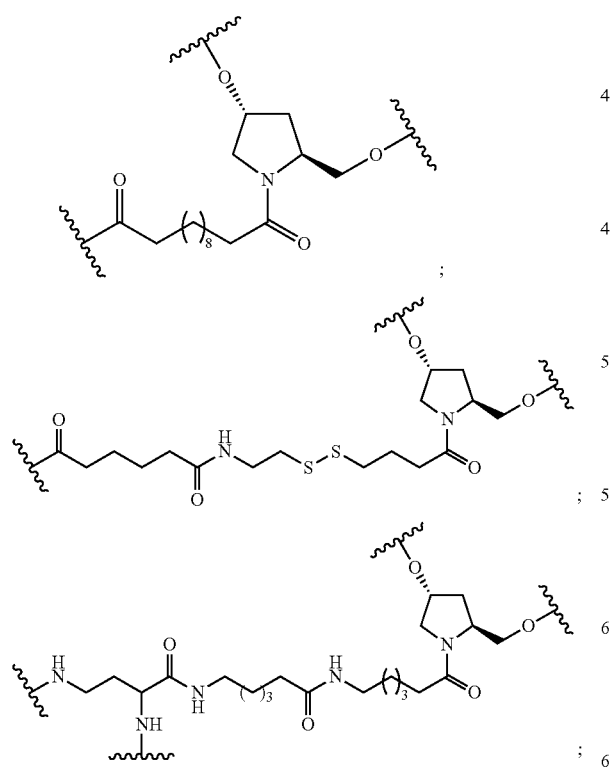
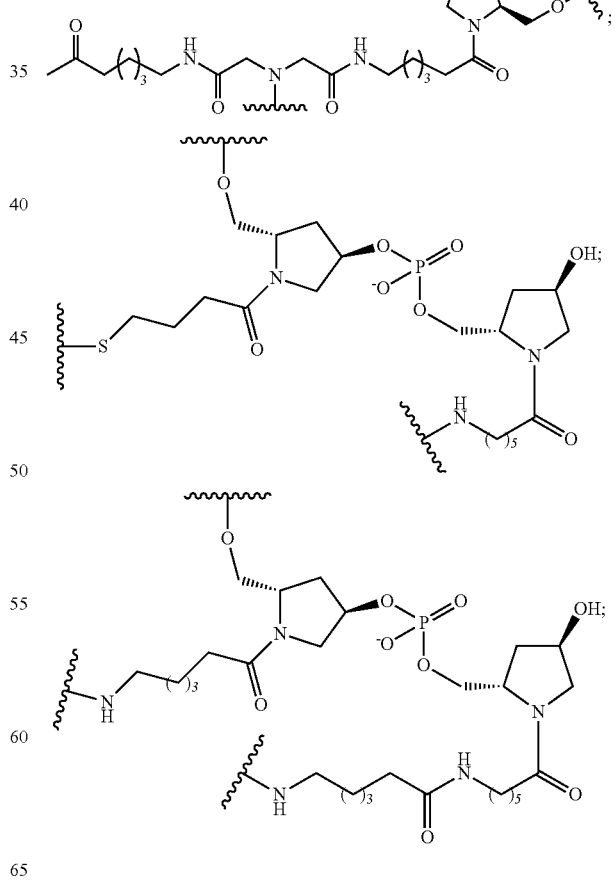

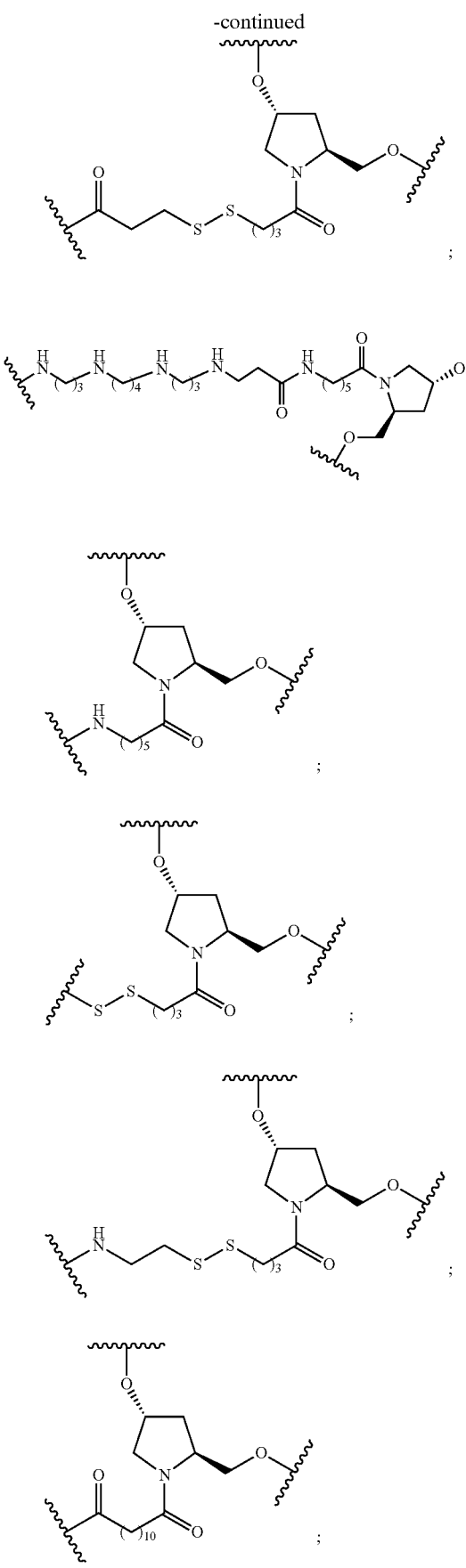
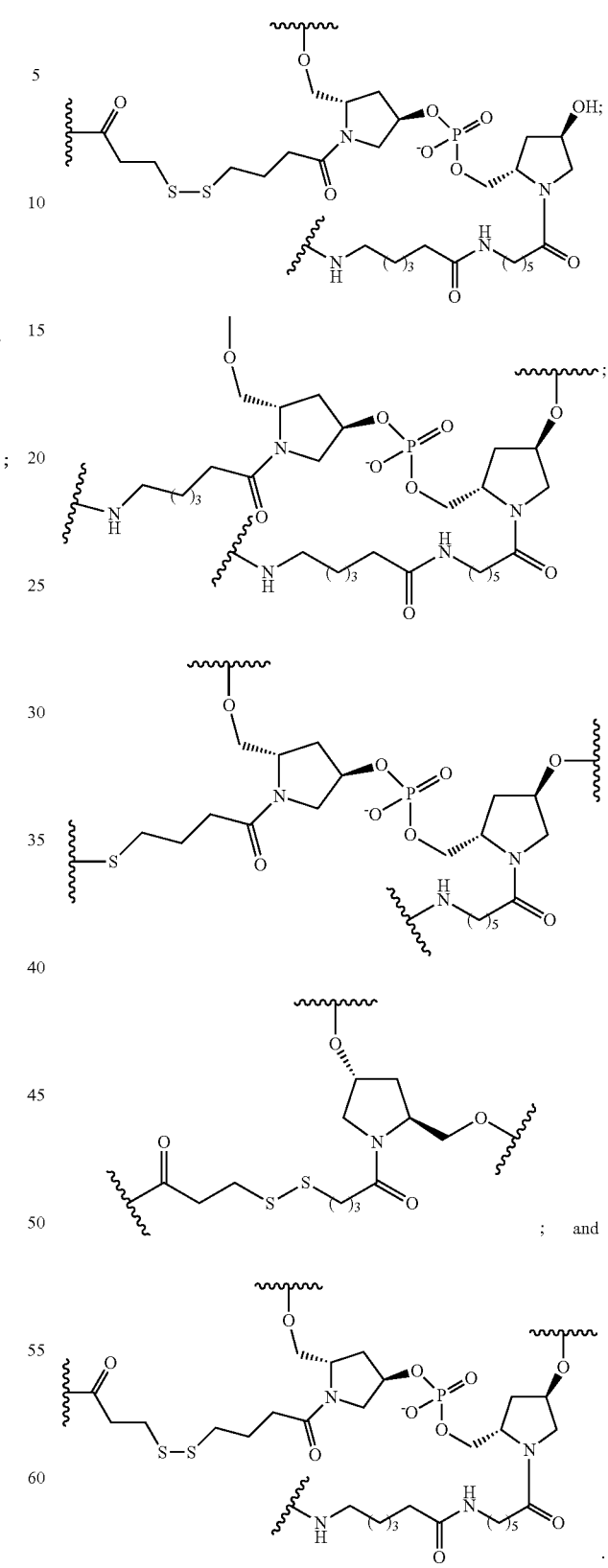
In certain embodiments, a linker has a structure selected from among:

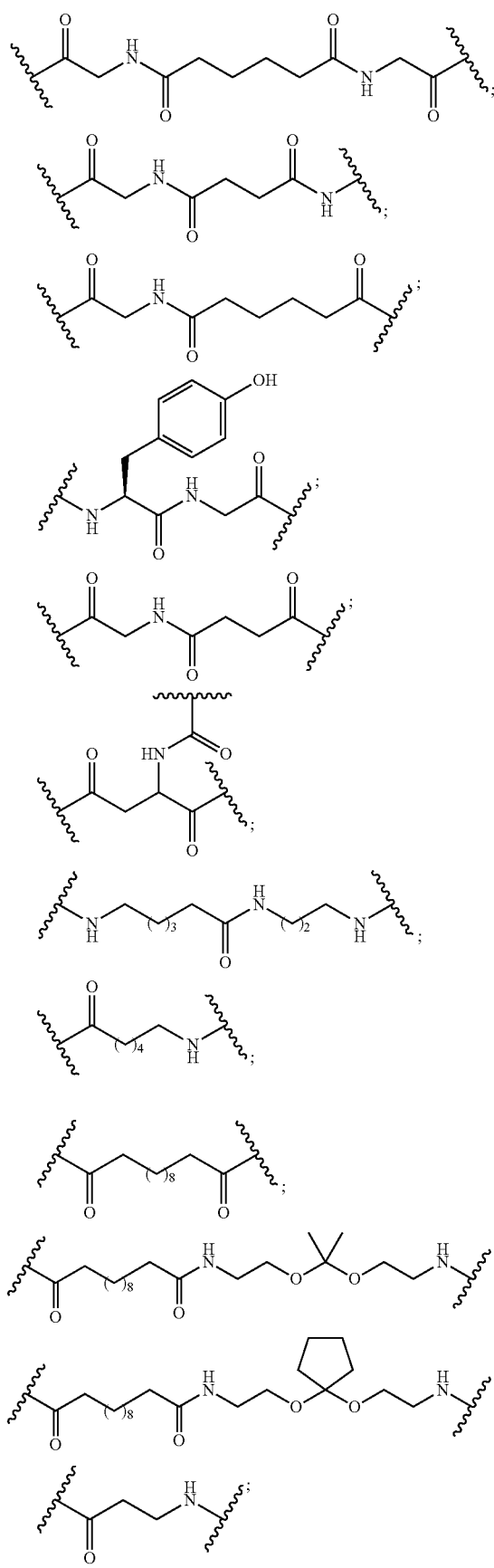
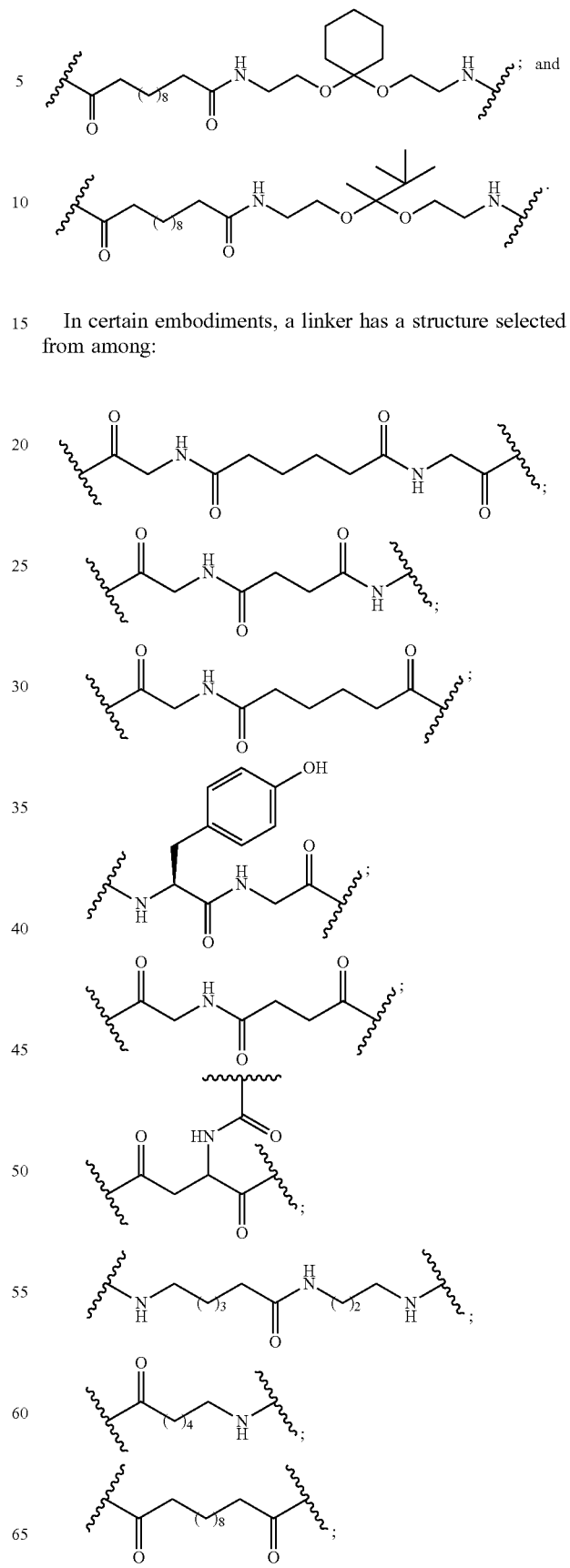
-continued
In certain embodiments, a linker has a structure selected from among:

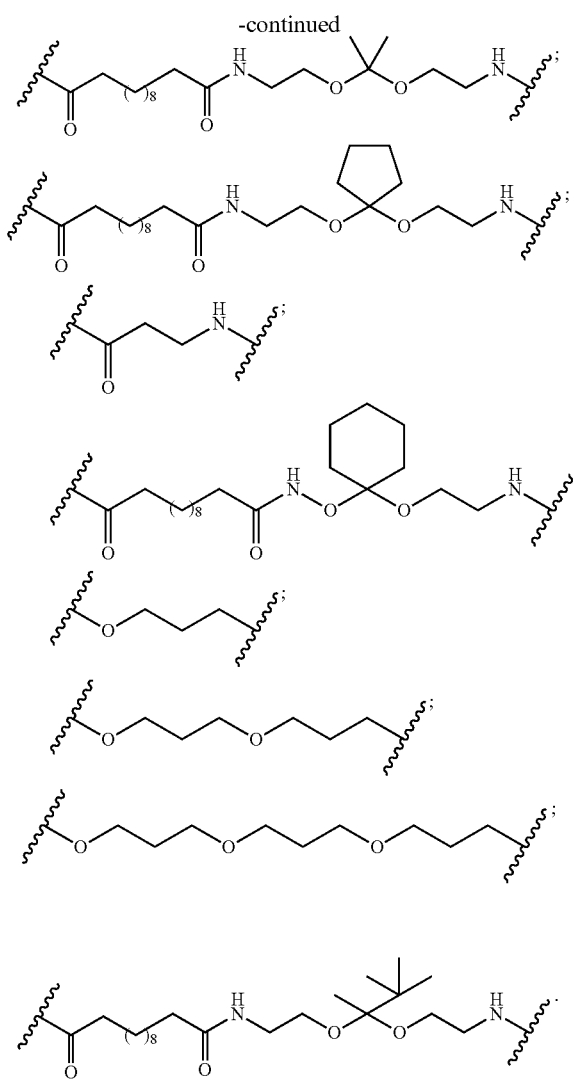
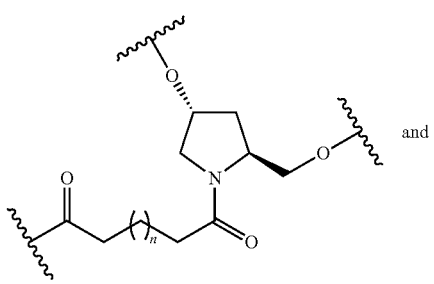
wherein n is from 1 to 20.
In certain embodiments, a linker has a structure selected from among:
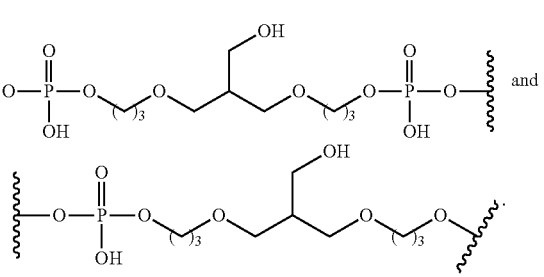
In certain embodiments, a linker has a structure selected from among:
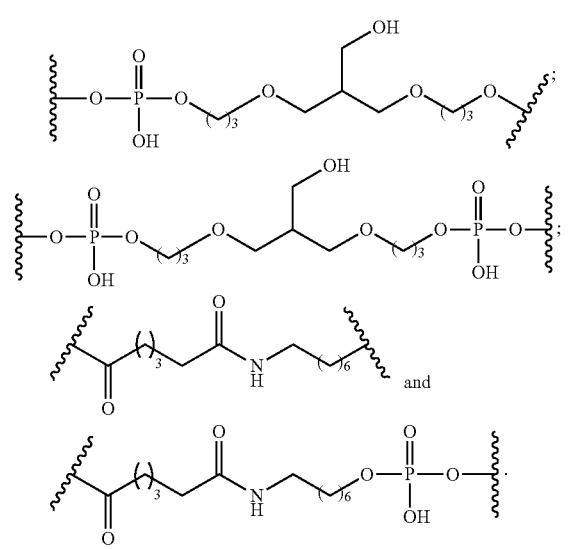
In certain embodiments, a linker has a structure selected from among:
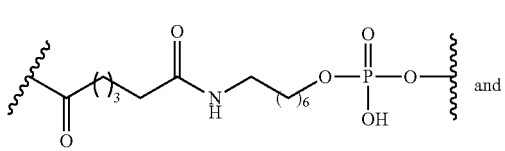
In certain embodiments, a linker has a structure selected from among:

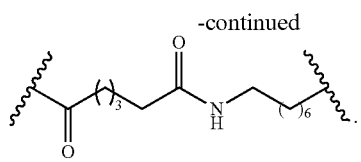

In certain embodiments, the conjugate linker has the structure:

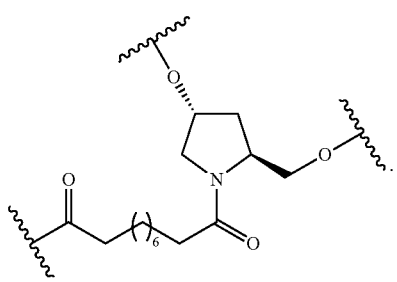

In certain embodiments, the conjugate linker has the structure:

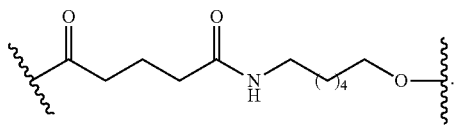

In certain embodiments, a linker has a structure selected from among:

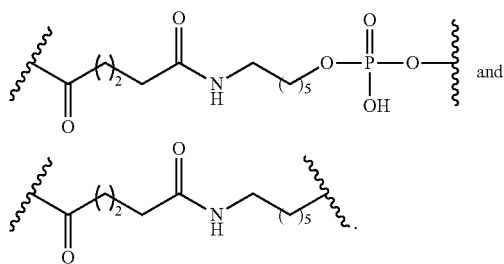

In certain embodiments, a linker has a structure selected from among:

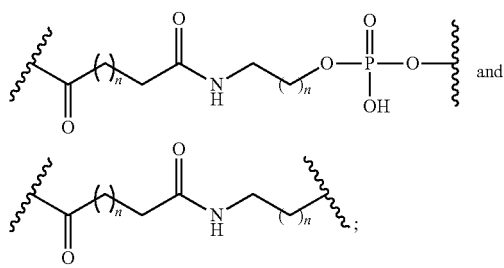

wherein each n is independently, 0, 1, 2, 3, 4, 5, 6, or 7.

iii. Certain Cell-Targeting Moieties

In certain embodiments, conjugate groups comprise cell-targeting moieties. Certain such cell-targeting moieties increase cellular uptake of antisense compounds. In certain embodiments, cell-targeting moieties comprise a branching group, one or more tether, and one or more ligand. In certain embodiments, cell-targeting moieties comprise a branching group, one or more tether, one or more ligand and one or more cleavable bond.

1. Certain Branching Groups

In certain embodiments, the conjugate groups comprise a targeting moiety comprising a branching group and at least two tethered ligands. In certain embodiments, the branching group attaches the conjugate linker. In certain embodiments, the branching group attaches the cleavable moiety. In certain embodiments, the branching group attaches the antisense oligonucleotide. In certain embodiments, the branching group is covalently attached to the linker and each of the tethered ligands. In certain embodiments, the branching group comprises a branched aliphatic group comprising groups selected from alkyl, amide, disulfide, polyethylene glycol, ether, thioether and hydroxylamino groups. In certain embodiments, the branching group comprises groups selected from alkyl, amide and ether groups. In certain embodiments, the branching group comprises groups selected from alkyl and ether groups. In certain embodiments, the branching group comprises a mono or polycyclic ring system. In certain embodiments, the branching group comprises one or more cleavable bond. In certain embodiments, the conjugate group does not include a branching group.

In certain embodiments, a branching group has a structure selected from among:

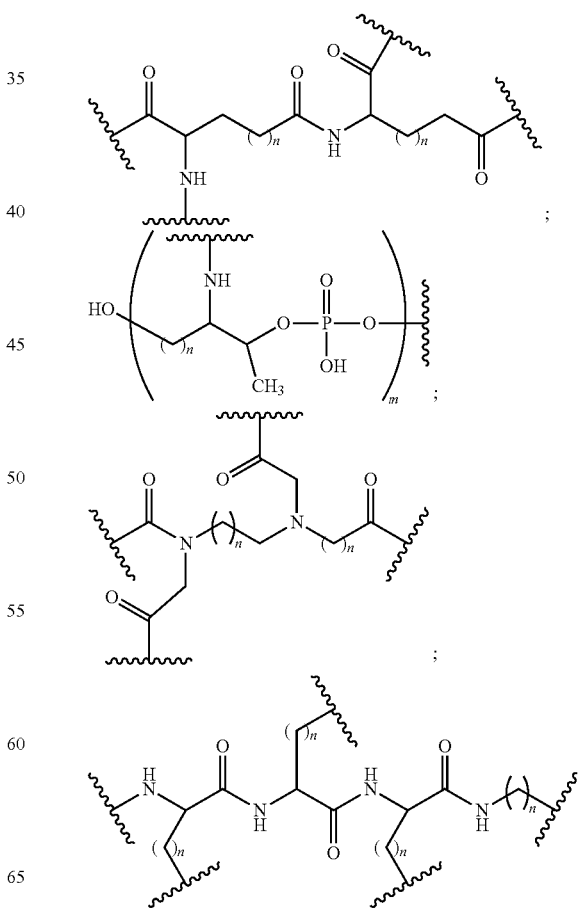

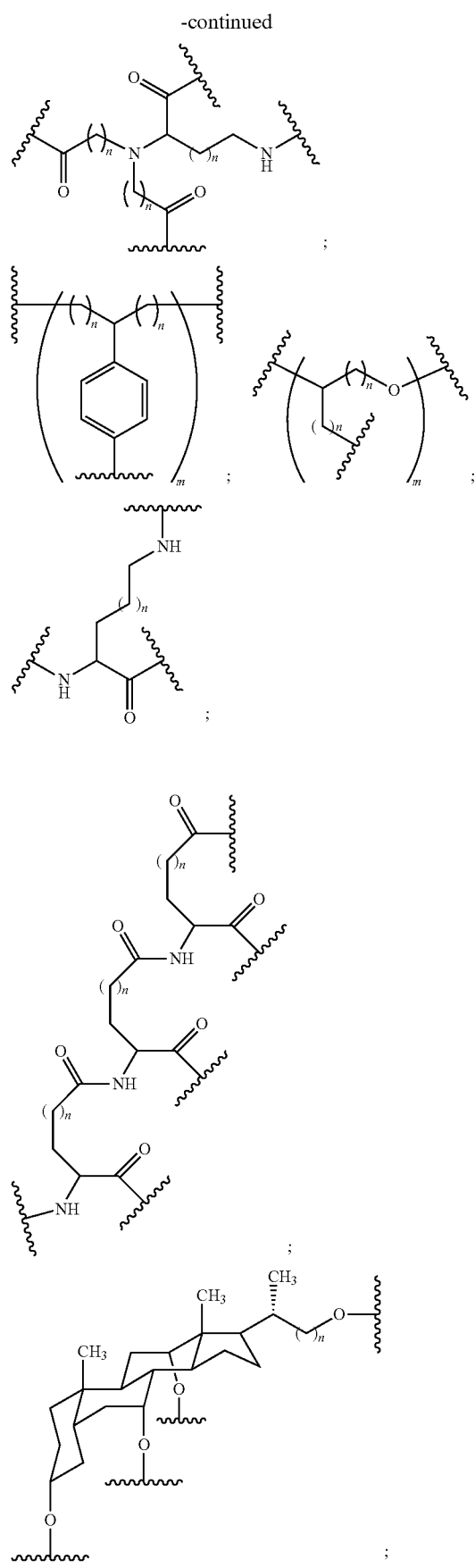
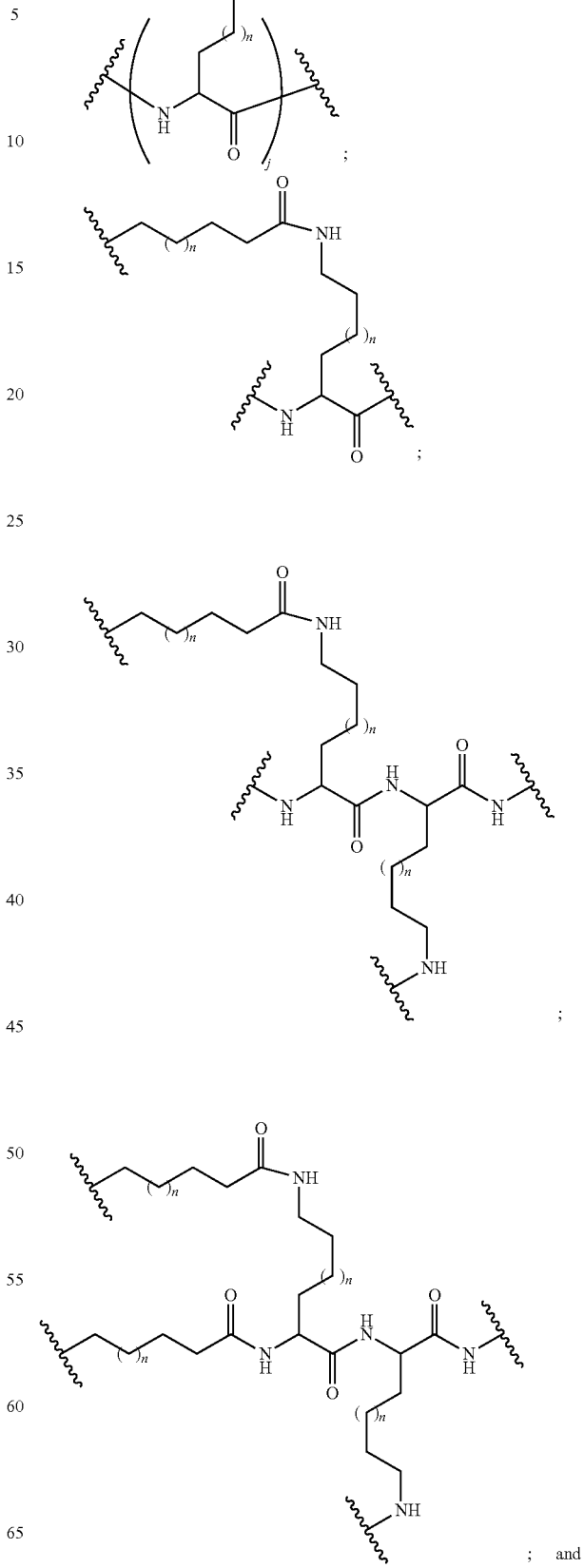

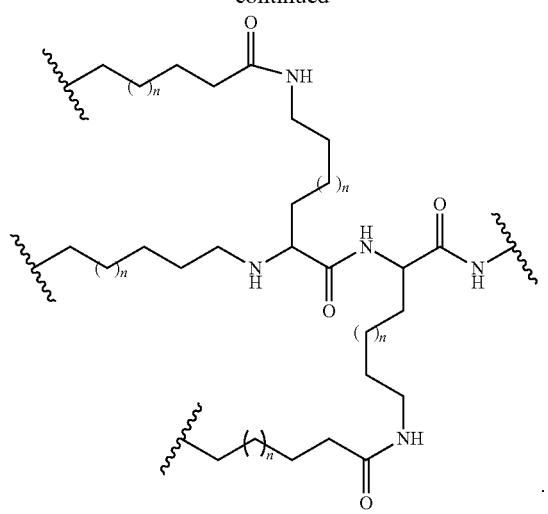
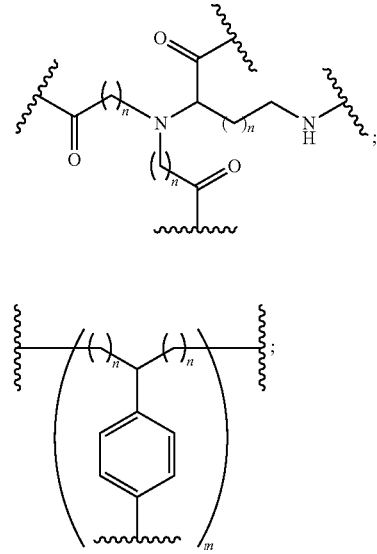
wherein each n is, independently, from 1 to 20;
j is from 1 to 3; and
m is from 2 to 6.
In certain embodiments, a branching group has a structure selected from among:
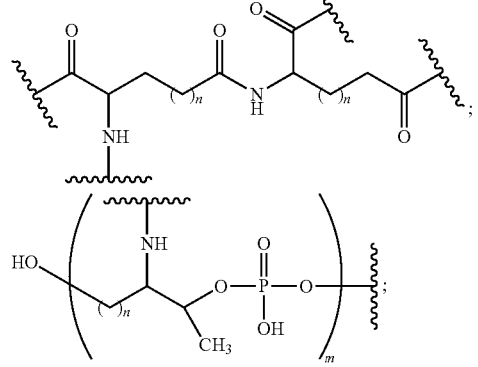
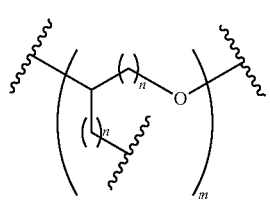
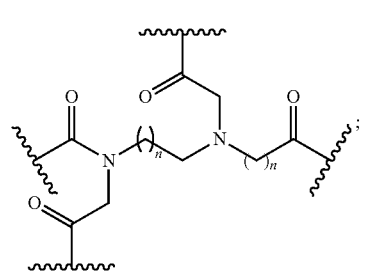
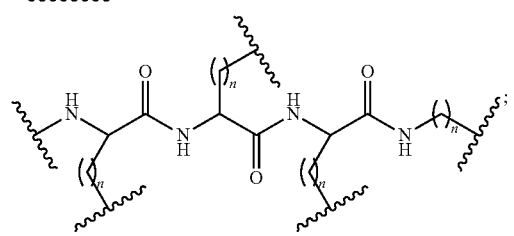
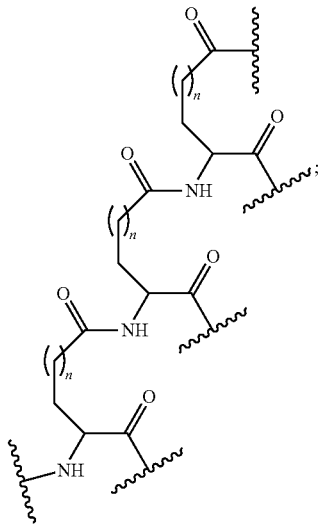

101
-continued
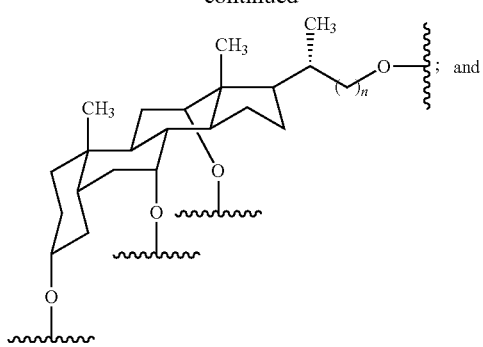
and
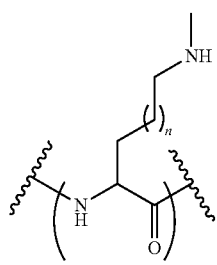
wherein each n is, independently, from 1 to 20; and
m is from 2 to 6.
In certain embodiments, a branching group has a structure selected from among:
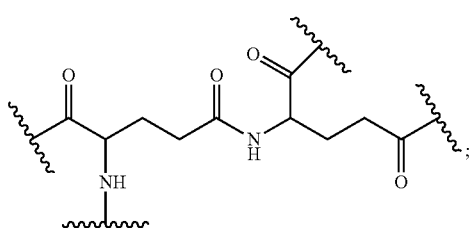
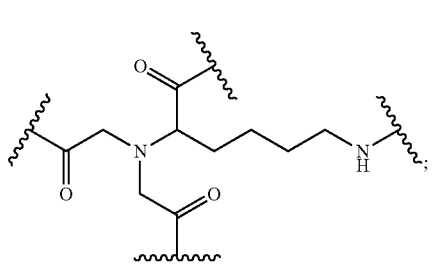
102
-continued
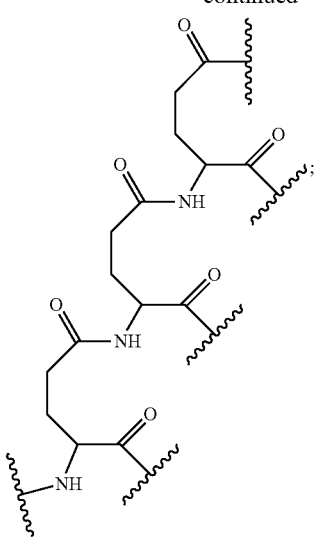
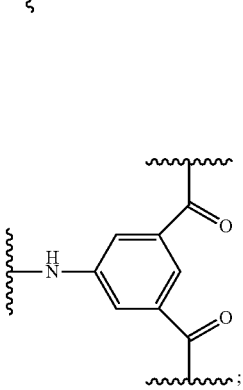
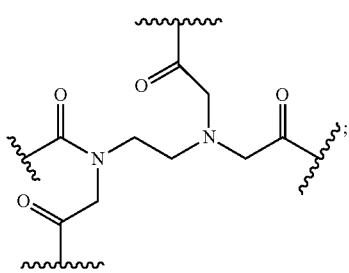
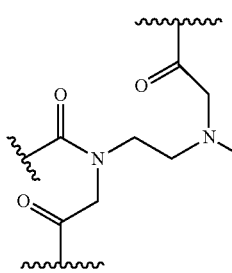
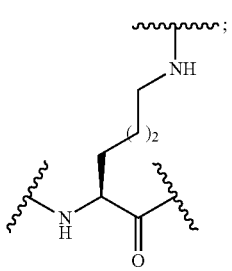

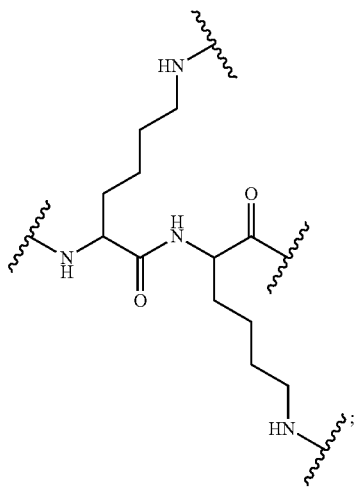
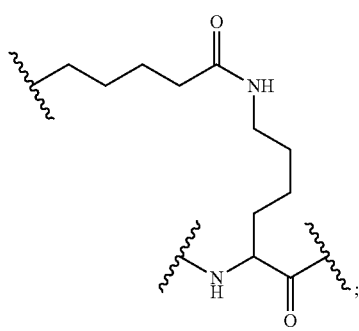
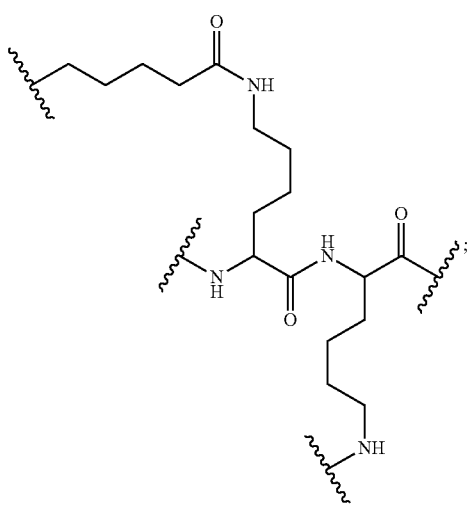
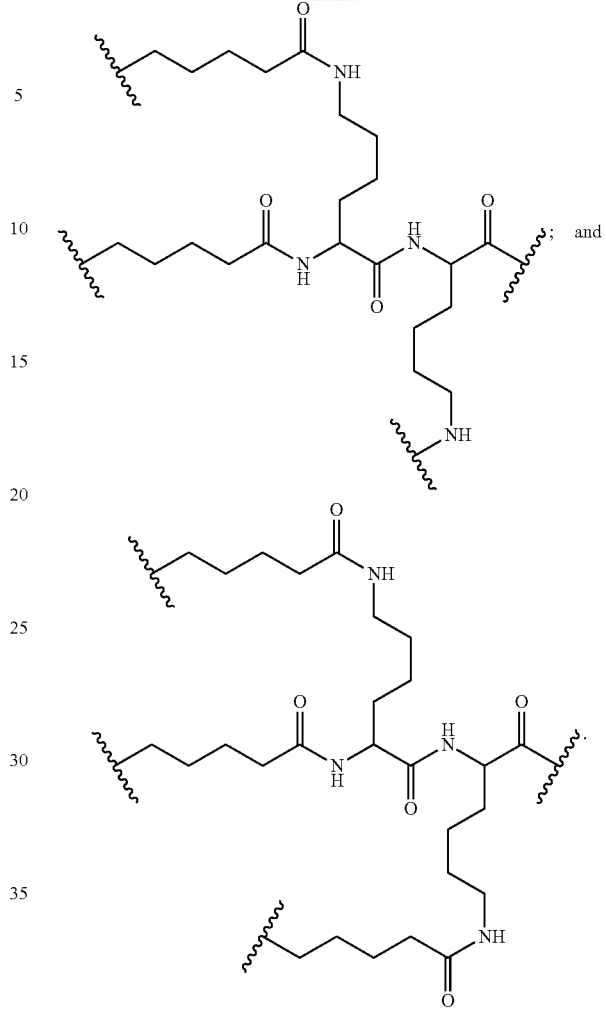
In certain embodiments, a branching group has a structure selected from among:
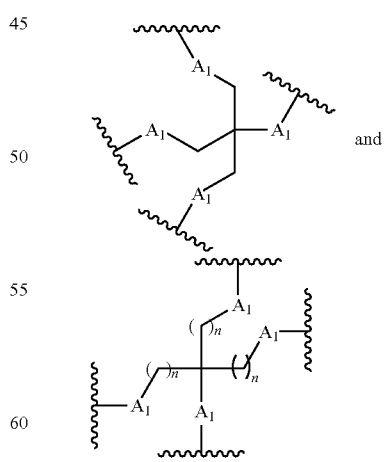
wherein each $A_1$ is independently, O, S, C=O or NH; and each n is, independently, from 1 to 20.
In certain embodiments, a branching group has a structure selected from among:

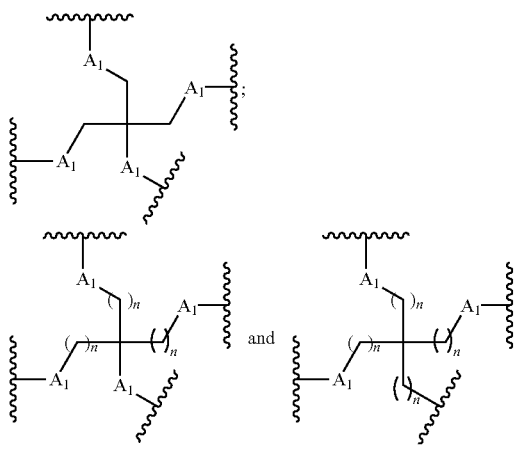

wherein each $A_1$ is independently, O, S, C=O or NH; and each n is, independently, from 1 to 20.

In certain embodiments, a branching group has a structure selected from among:

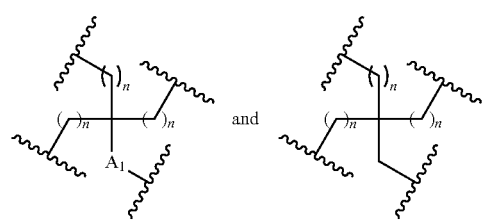

wherein $A_1$ is O, S, C=O or NH; and
each n is, independently, from 1 to 20.

In certain embodiments a branching group has a structure selected from among:

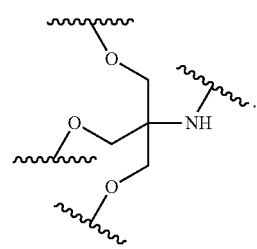 [SMILES: *NC(CO*)(CO*)CO*]

In certain embodiments, a branching group has a structure selected from among:

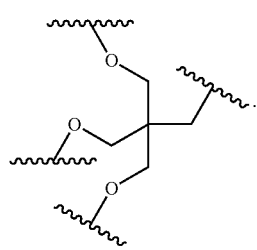 [SMILES: *CC(CO*)(CO*)CO*]

In certain embodiments, a branching group has a structure selected from among:

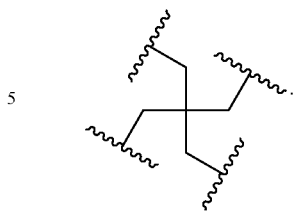

2. Certain Tethers

In certain embodiments, conjugate groups comprise one or more tethers covalently attached to the branching group. In certain embodiments, conjugate groups comprise one or more tethers covalently attached to the linking group. In certain embodiments, each tether is a linear aliphatic group comprising one or more groups selected from alkyl, ether, thioether, disulfide, amide and polyethylene glycol groups in any combination. In certain embodiments, each tether is a linear aliphatic group comprising one or more groups selected from alkyl, substituted alkyl, ether, thioether, disulfide, amide, phosphodiester and polyethylene glycol groups in any combination. In certain embodiments, each tether is a linear aliphatic group comprising one or more groups selected from alkyl, ether and amide groups in any combination. In certain embodiments, each tether is a linear aliphatic group comprising one or more groups selected from alkyl, substituted alkyl, phosphodiester, ether and amide groups in any combination. In certain embodiments, each tether is a linear aliphatic group comprising one or more groups selected from alkyl and phosphodiester in any combination. In certain embodiments, each tether comprises at least one phosphorus linking group or neutral linking group.

In certain embodiments, the tether includes one or more cleavable bond. In certain embodiments, the tether is attached to the branching group through either an amide or an ether group. In certain embodiments, the tether is attached to the branching group through a phosphodiester group. In certain embodiments, the tether is attached to the branching group through a phosphorus linking group or neutral linking group. In certain embodiments, the tether is attached to the branching group through an ether group. In certain embodiments, the tether is attached to the ligand through either an amide or an ether group. In certain embodiments, the tether is attached to the ligand through an ether group. In certain embodiments, the tether is attached to the ligand through either an amide or an ether group. In certain embodiments, the tether is attached to the ligand through an ether group.

In certain embodiments, each tether comprises from about 8 to about 20 atoms in chain length between the ligand and the branching group. In certain embodiments, each tether group comprises from about 10 to about 18 atoms in chain length between the ligand and the branching group. In certain embodiments, each tether group comprises about 13 atoms in chain length.

In certain embodiments, a tether has a structure selected from among:

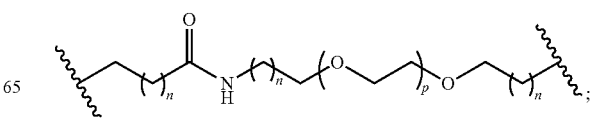

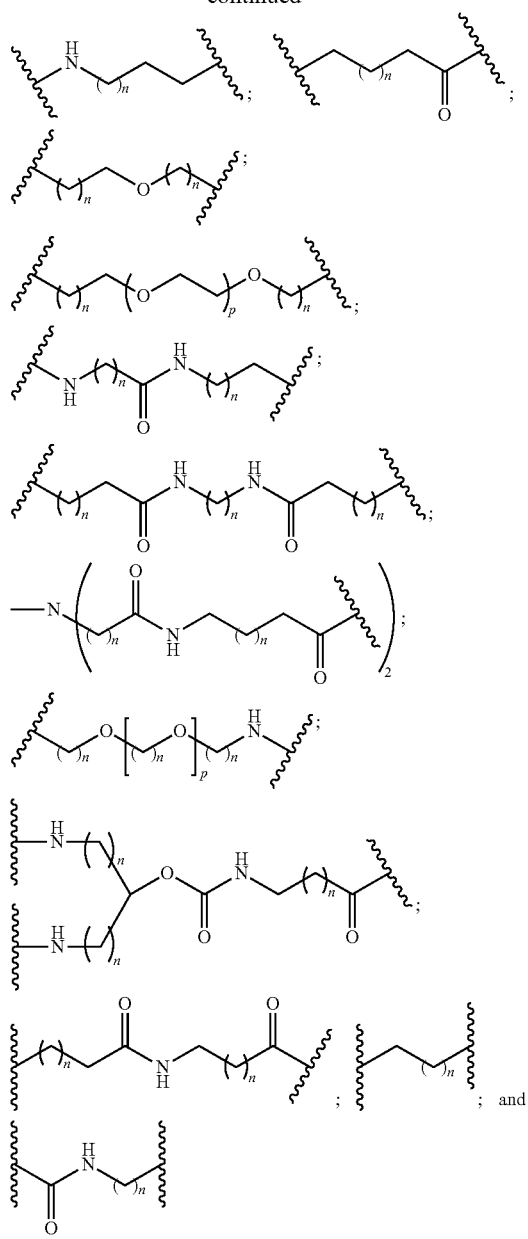

wherein each n is, independently, from 1 to 20; and each p is from 1 to about 6.

In certain embodiments, a tether has a structure selected from among:

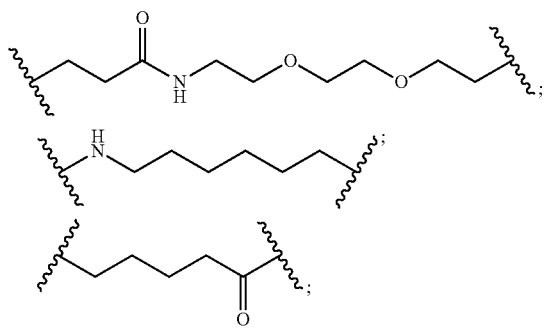

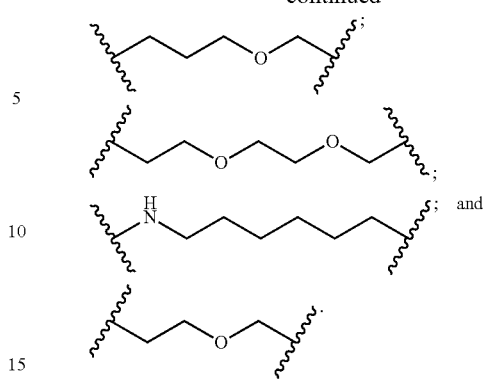

In certain embodiments, a tether has a structure selected from among:

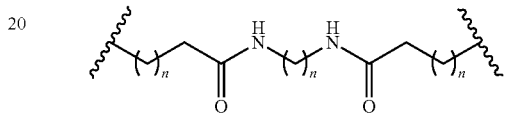

wherein each n is, independently, from 1 to 20.

In certain embodiments, a tether has a structure selected from among:

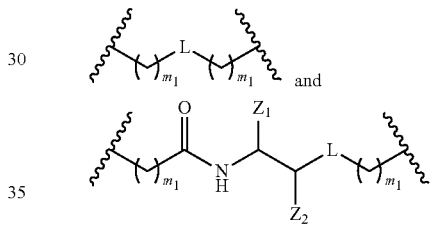

wherein L is either a phosphorus linking group or a neutral linking group;
$Z_1$ is $C(=O)O-R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and
each $m_1$ is, independently, from 0 to 20 wherein at least one $m_1$ is greater than 0 for each tether.

In certain embodiments, a tether has a structure selected from among:

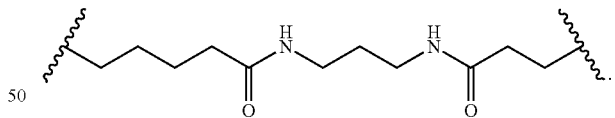

In certain embodiments, a tether has a structure selected from among:

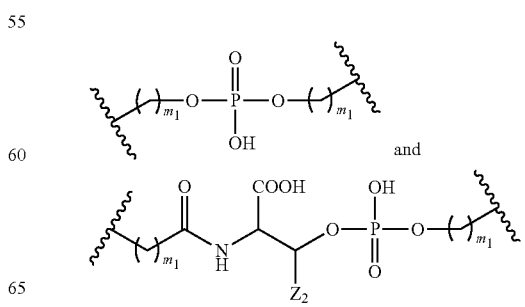

wherein $Z_2$ is H or $CH_3$; and each $m_1$ is, independently, from 0 to 20 wherein at least one $m_1$ is greater than 0 for each tether.

In certain embodiments, a tether has a structure selected from among:

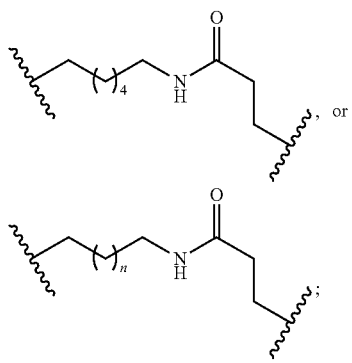

wherein each n is independently, 0, 1, 2, 3, 4, 5, 6, or 7.

In certain embodiments, a tether comprises a phosphorus linking group. In certain embodiments, a tether does not comprise any amide bonds. In certain embodiments, a tether comprises a phosphorus linking group and does not comprise any amide bonds.

3. Certain Ligands

In certain embodiments, the present disclosure provides ligands wherein each ligand is covalently attached to a tether. In certain embodiments, each ligand is selected to have an affinity for at least one type of receptor on a target cell. In certain embodiments, ligands are selected that have an affinity for at least one type of receptor on the surface of a mammalian liver cell. In certain embodiments, ligands are selected that have an affinity for the hepatic asialoglycoprotein receptor (ASGP-R). In certain embodiments, each ligand is a carbohydrate. In certain embodiments, each ligand is, independently selected from galactose, N-acetyl galactoseamine, mannose, glucose, glucosamone and fucose. In certain embodiments, each ligand is N-acetyl galactoseamine (GalNAc). In certain embodiments, the targeting moiety comprises 2 to 6 ligands. In certain embodiments, the targeting moiety comprises 3 ligands. In certain embodiments, the targeting moiety comprises 3 N-acetyl galactoseamine ligands.

In certain embodiments, the ligand is a carbohydrate, carbohydrate derivative, modified carbohydrate, multivalent carbohydrate cluster, polysaccharide, modified polysaccharide, or polysaccharide derivative. In certain embodiments, the ligand is an amino sugar or a thio sugar. For example, amino sugars may be selected from any number of compounds known in the art, for example glucosamine, sialic acid, α-D-galactosamine, N-Acetylgalactosamine, 2-acetamido-2-deoxy-D-galactopyranose (GalNAc), 2-Amino-3-O-[(R)-1-carboxyethyl]-2-deoxy-β-D-glucopyranose (β-muramic acid), 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose and N-sulfo-D-glucosamine, and N-Glycoloyl-α-neuraminic acid. For example, thio sugars may be selected from the group consisting of 5-Thio-β-D-glucopyranose, Methyl 2,3, 4-tri-O-acetyl-1-thio-6-O-trityl-α-D-glucopyranoside, 4-Thio-β-D-galactopyranose, and ethyl 3,4,6,7-tetra-O-acetyl-2-deoxy-1,5-dithio-α-D-gluco-heptopyranoside.

In certain embodiments, "GalNac" or "Gal-NAc" refers to 2-(Acetylamino)-2-deoxy-D-galactopyranose, commonly referred to in the literature as N-acetyl galactosamine. In certain embodiments, "N-acetyl galactosamine" refers to 2-(Acetylamino)-2-deoxy-D-galactopyranose. In certain embodiments, "GalNac" or "Gal-NAc" refers to 2-(Acetylamino)-2-deoxy-D-galactopyranose. In certain embodiments, "GalNac" or "Gal-NAc" refers to 2-(Acetylamino)-2-deoxy-D-galactopyranose, which includes both the β-form: 2-(Acetylamino)-2-deoxy-β-D-galactopyranose and α-form: 2-(Acetylamino)-2-deoxy-D-galactopyranose. In certain embodiments, both the β-form: 2-(Acetylamino)-2-deoxy-β-D-galactopyranose and α-form: 2-(Acetylamino)-2-deoxy-D-galactopyranose may be used interchangeably. Accordingly, in structures in which one form is depicted, these structures are intended to include the other form as well. For example, where the structure for an α-form: 2-(Acetylamino)-2-deoxy-D-galactopyranose is shown, this structure is intended to include the other form as well. In certain embodiments, In certain preferred embodiments, the β-form 2-(Acetylamino)-2-deoxy-D-galactopyranose is the preferred embodiment.

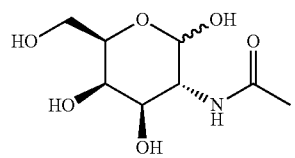

2-(Acetylamino)-2-deoxy-D-galactopyranose

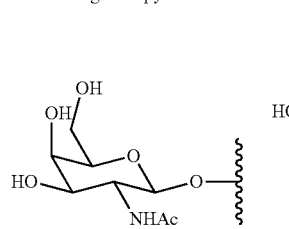

2-(Acetylamino)-2-deoxy-β-D-galactopyranose

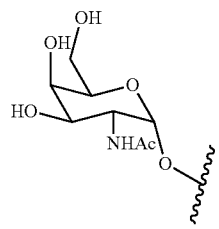

2-(Acetylamino)-2-deoxy-α-D-galactopyranose

In certain embodiments one or more ligand has a structure selected from among:

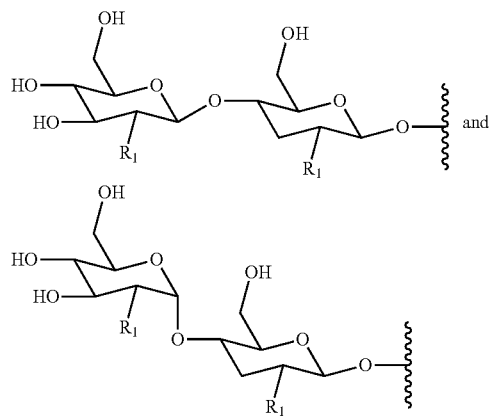

wherein each $R_1$ is selected from OH and NHCOOH.

In certain embodiments one or more ligand has a structure selected from among:

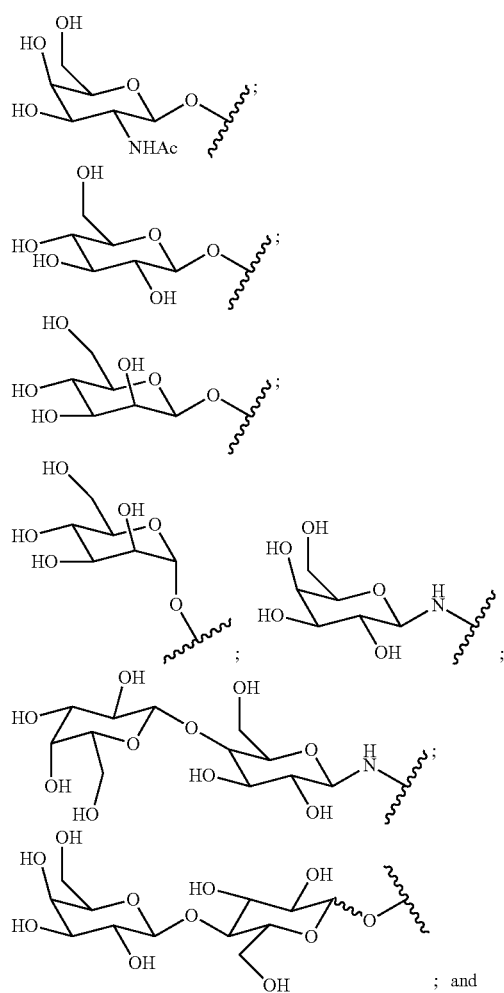
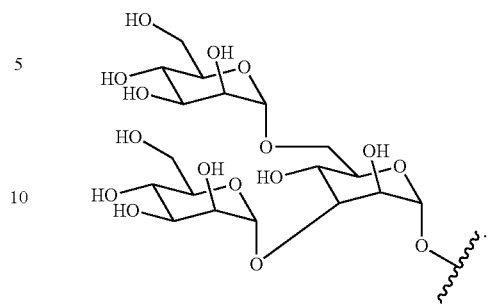
In certain embodiments one or more ligand has a structure selected from among:
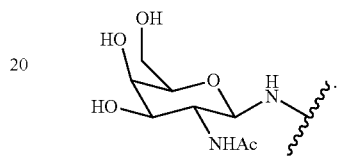
In certain embodiments one or more ligand has a structure selected from among:
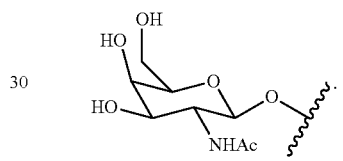
i. Certain Conjugates
In certain embodiments, conjugate groups comprise the structural features above. In certain such embodiments, conjugate groups have the following structure:
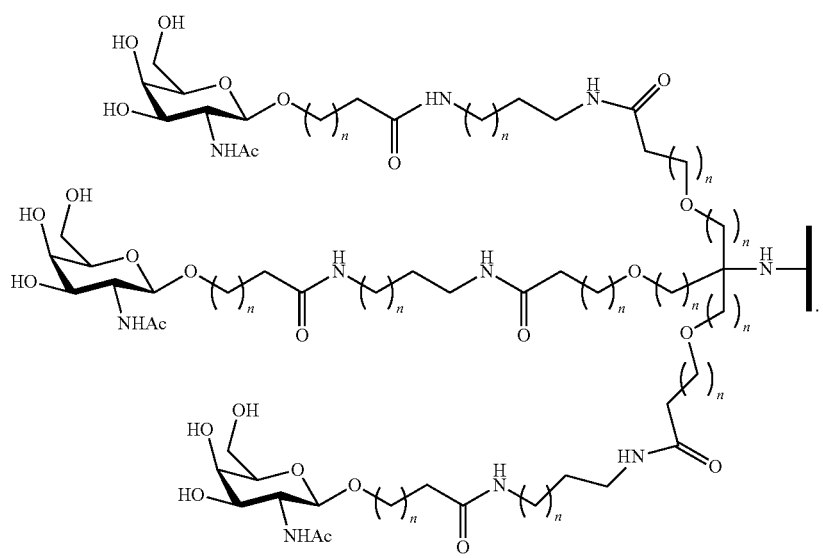

wherein each n is, independently, from 1 to 20.

In certain such embodiments, conjugate groups have the following structure:

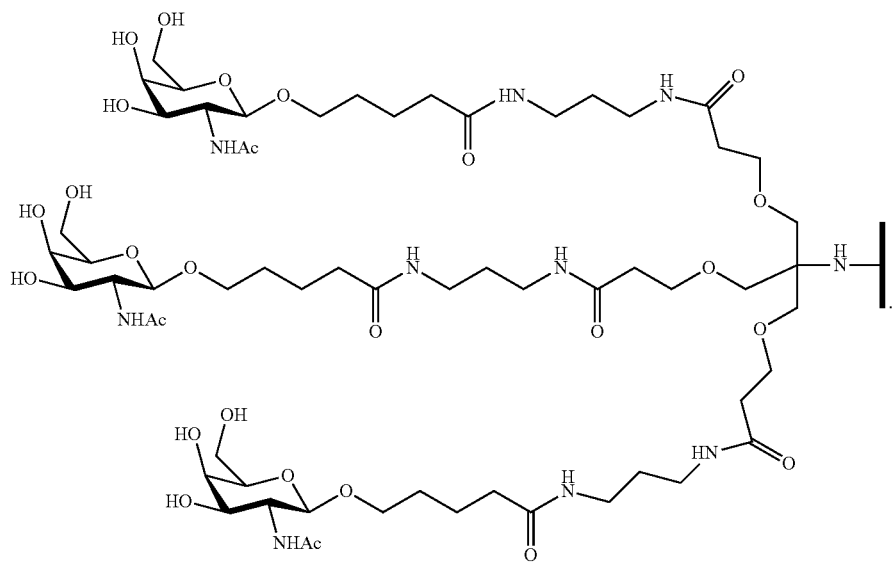

In certain such embodiments, conjugate groups have the following structure:

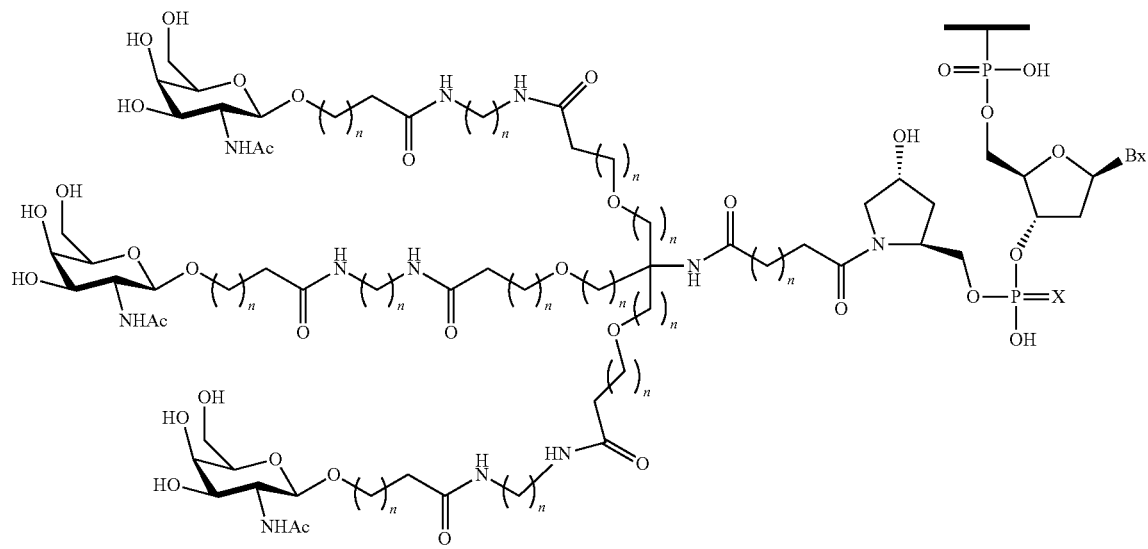

wherein each n is, independently, from 1 to 20;
Z is H or a linked solid support;
Q is an antisense compound;
X is O or S; and Bx is a heterocyclic base moiety.

In certain such embodiments, conjugate groups have the following structure:

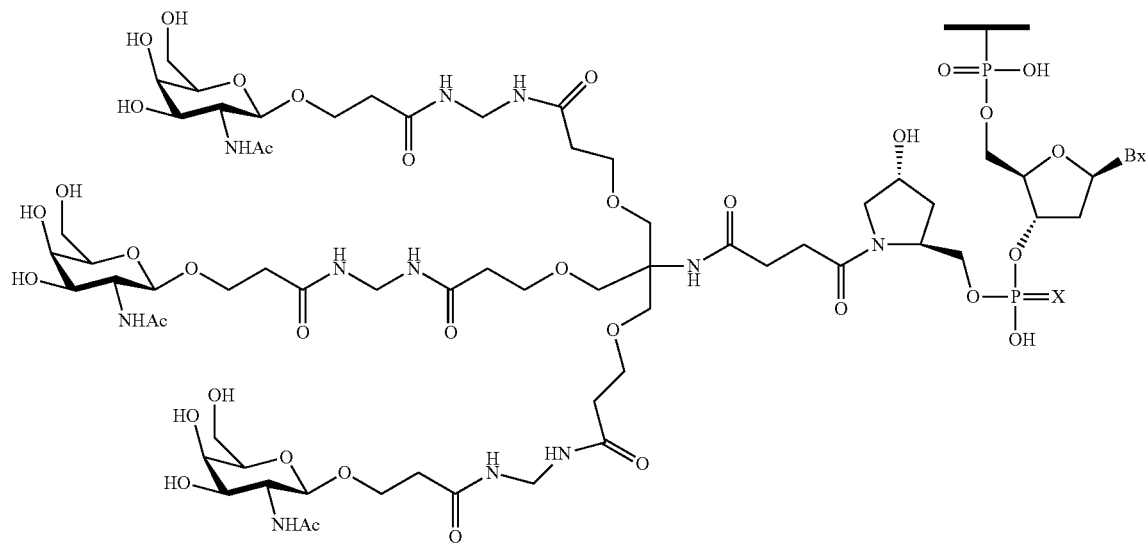
In certain such embodiments, conjugate groups have the following structure:
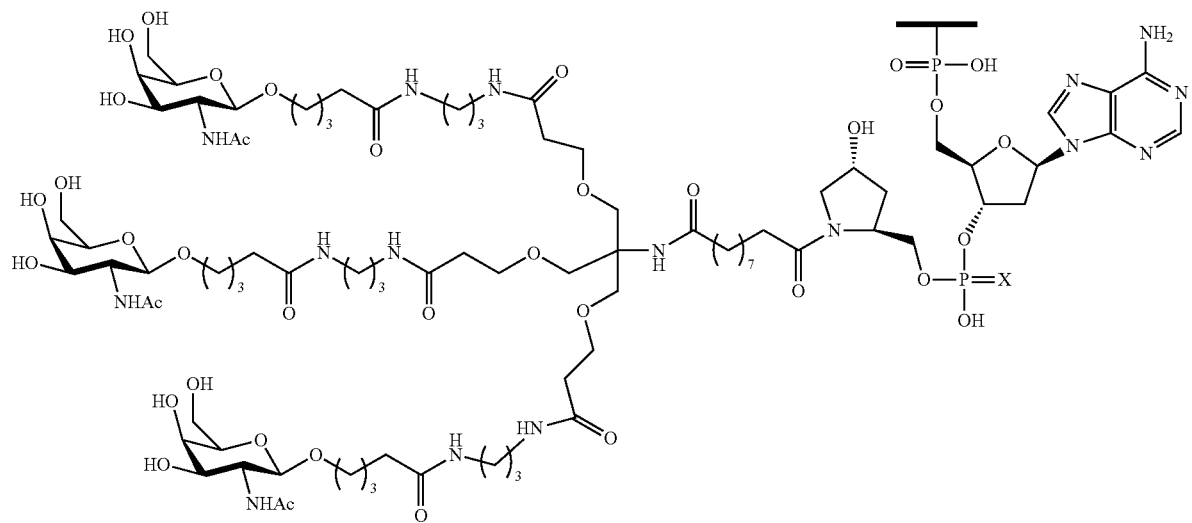
In certain such embodiments, conjugate groups have the following structure:

117
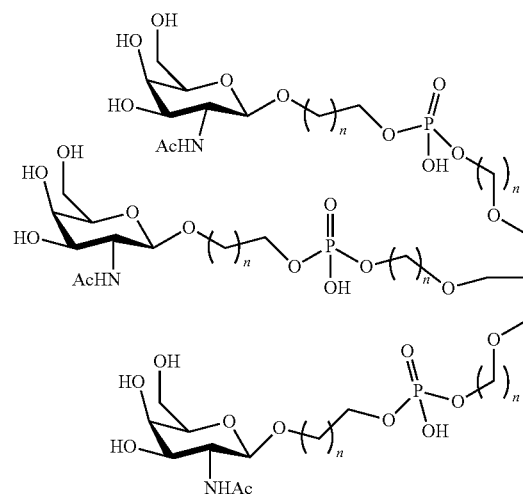
118
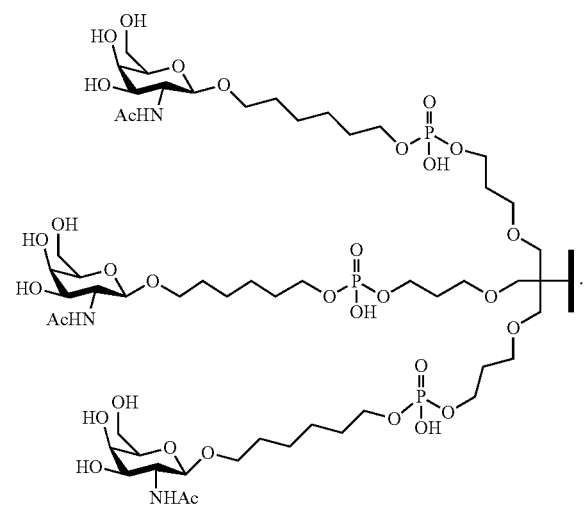
In certain such embodiments, conjugate groups have the following structure:
In certain such embodiments, conjugate groups have the following structure:
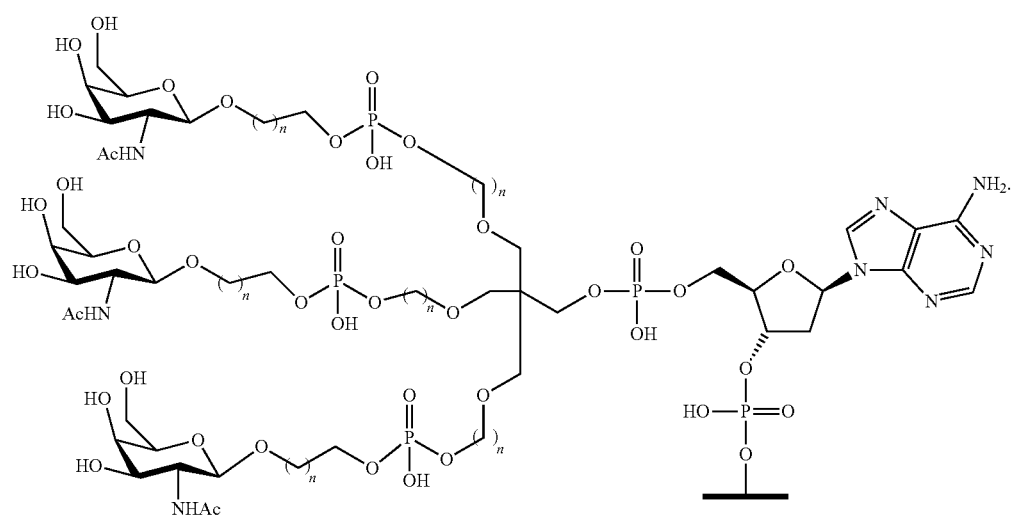

In certain such embodiments, conjugate groups have the following structure:
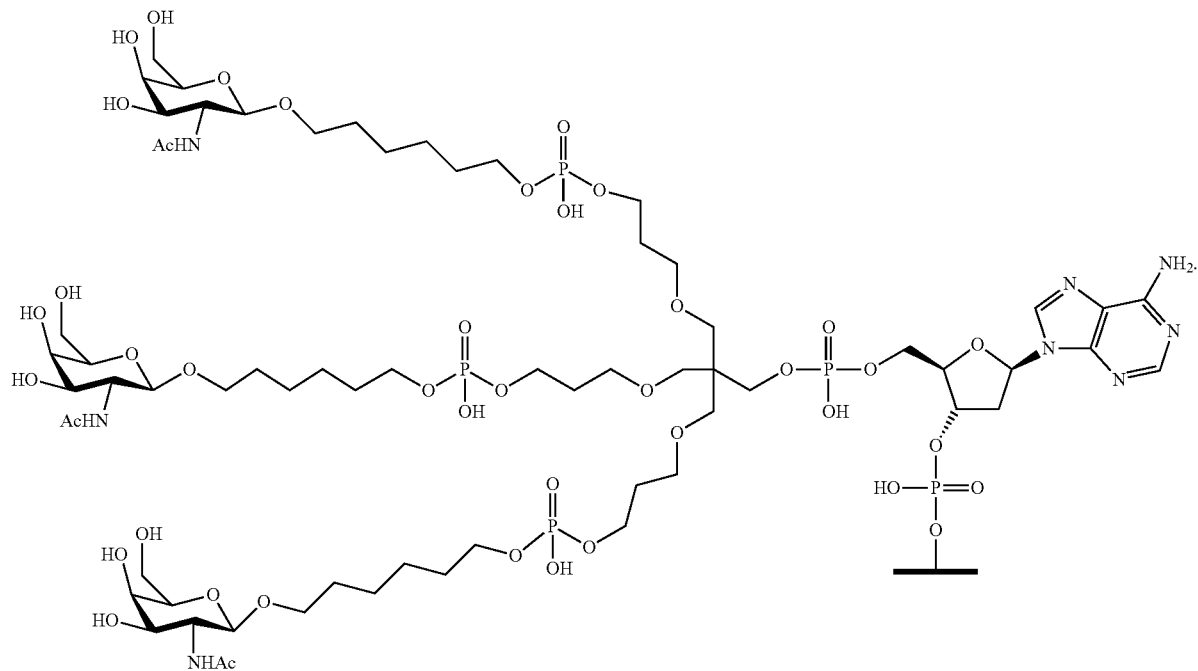
In certain such embodiments, conjugate groups have the following structure:
In certain such embodiments, conjugate groups have the following structure:
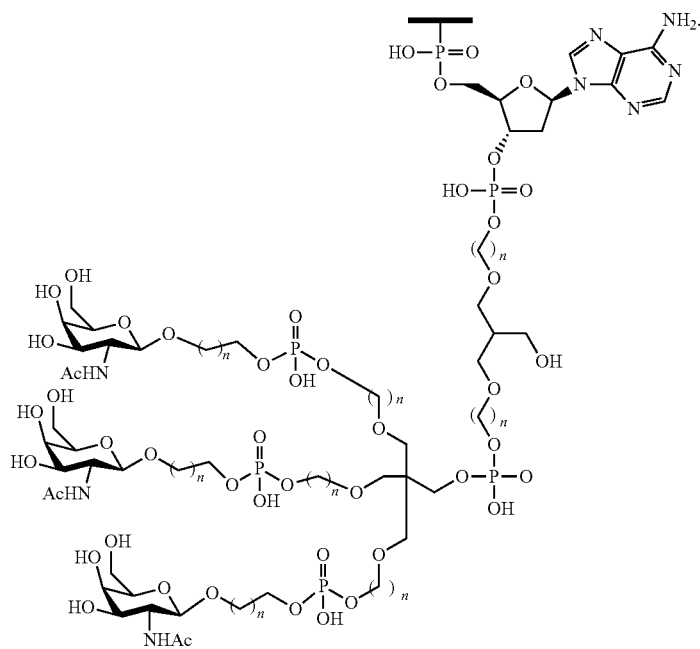

In certain embodiments, conjugates do not comprise a pyrrolidine.
In certain such embodiments, conjugate groups have the following structure:
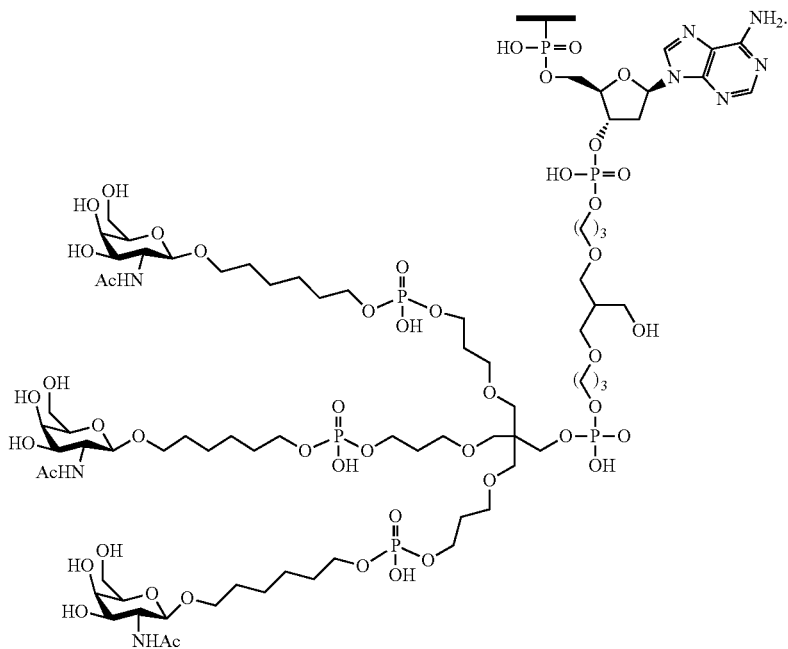
In certain such embodiments, conjugate groups have the following structure:
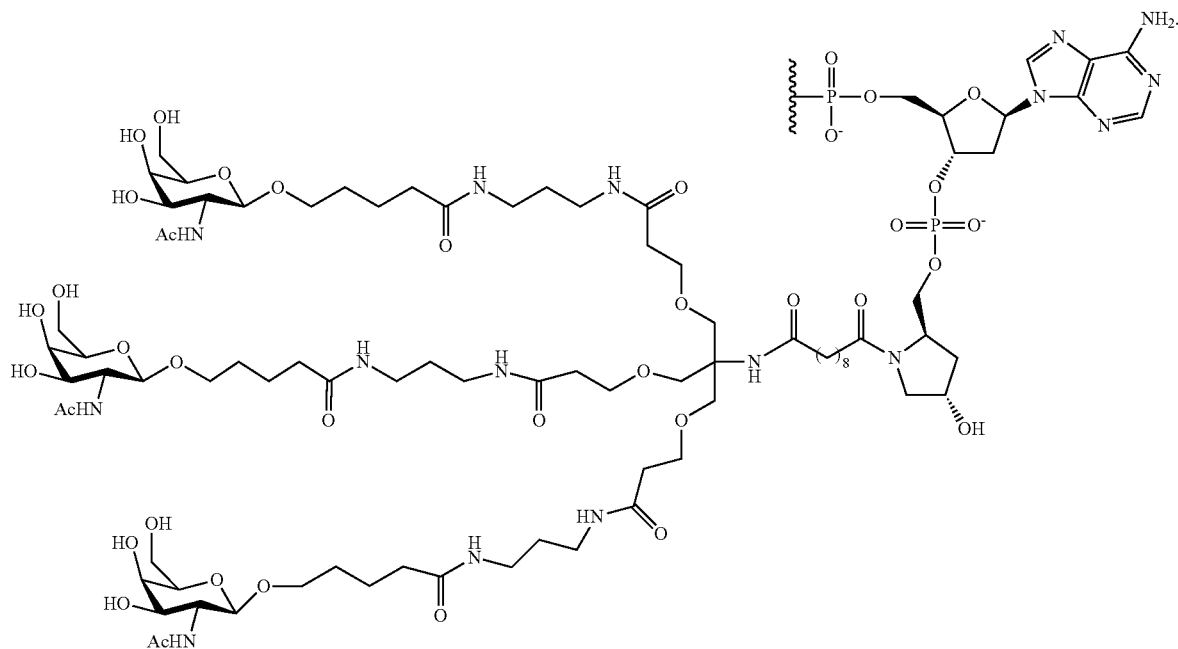

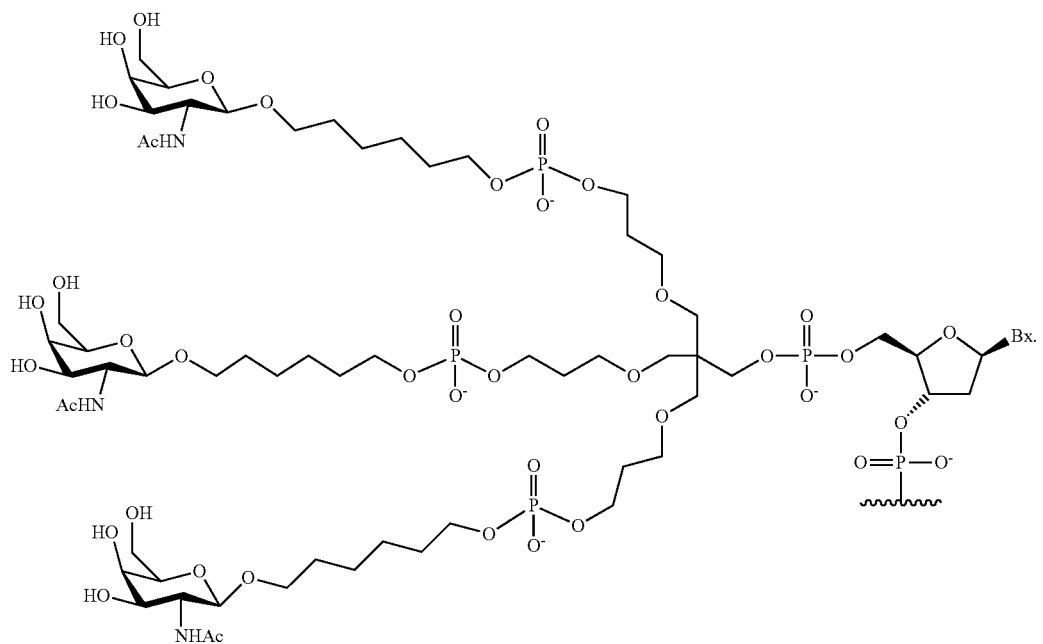
In certain such embodiments, conjugate groups have the following structure:
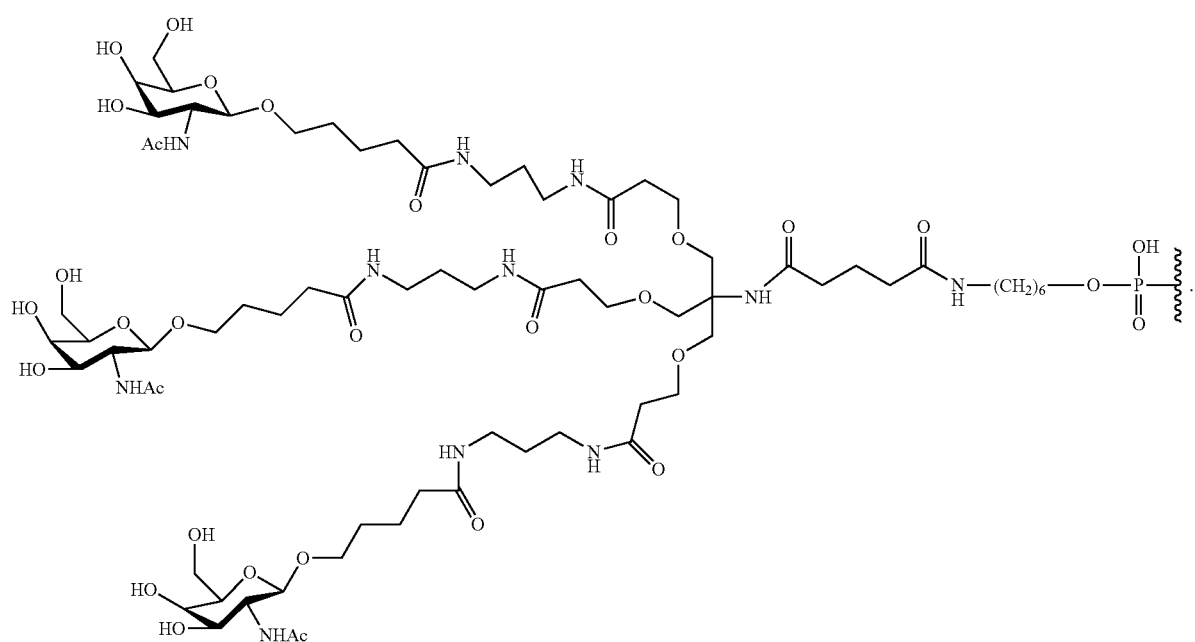
In certain such embodiments, conjugate groups have the following structure:

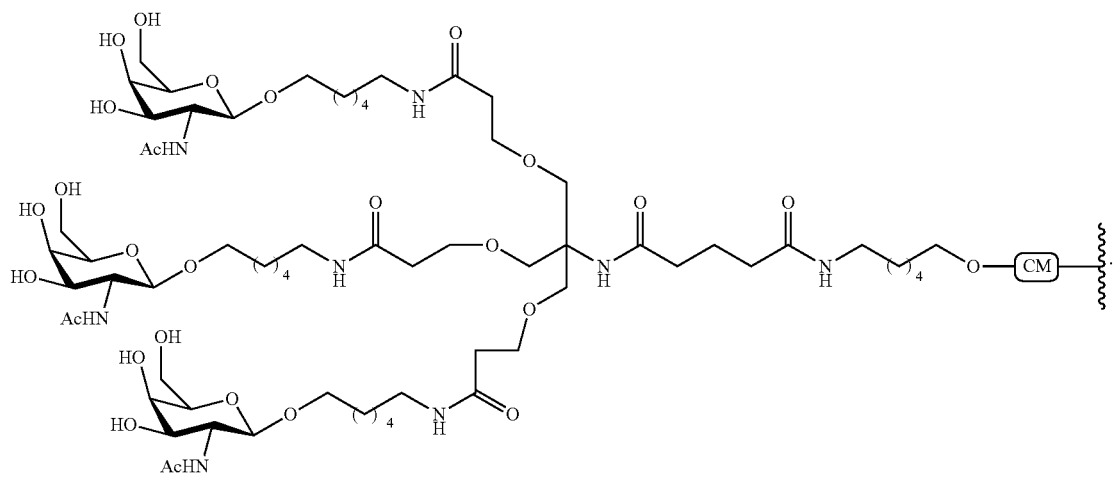
In certain such embodiments, conjugate groups have the following structure:
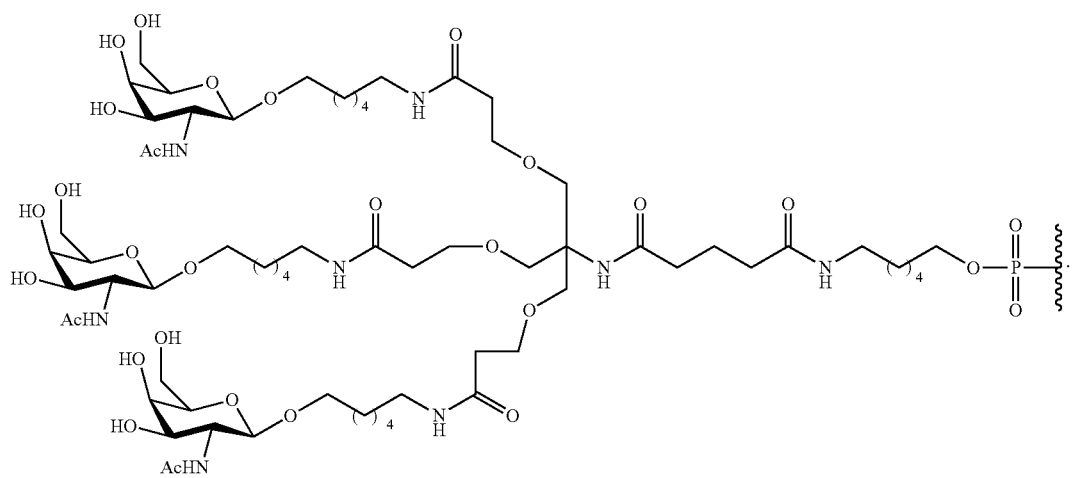
In certain such embodiments, conjugate groups have the following structure:
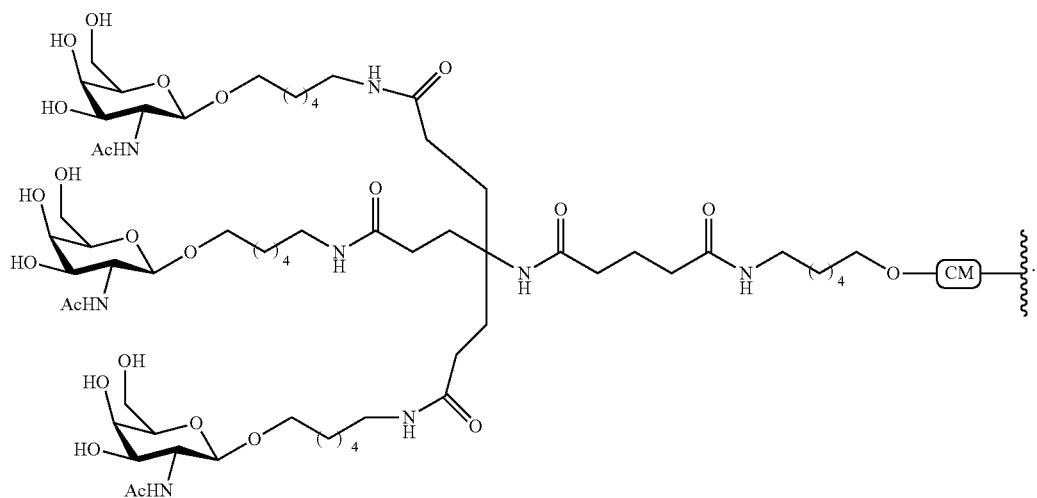

In certain such embodiments, conjugate groups have the following structure:
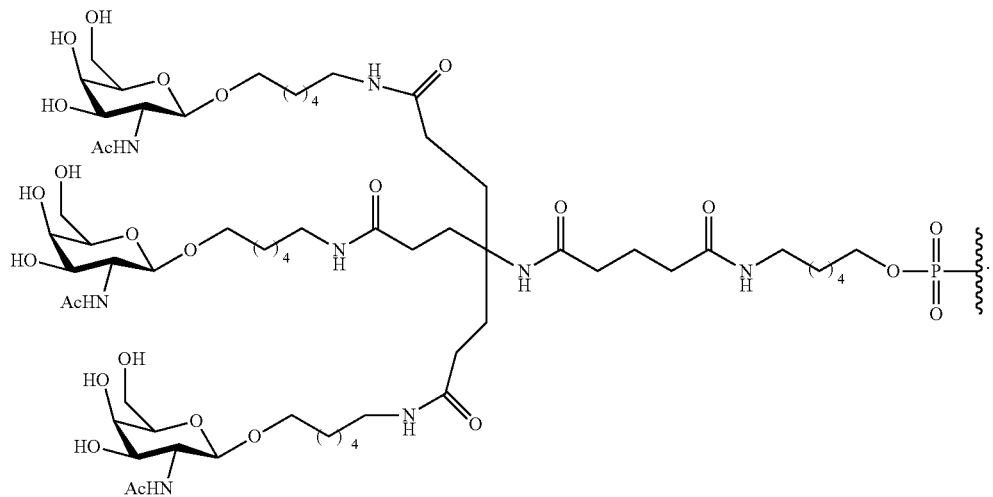
In certain such embodiments, conjugate groups have the following structure:
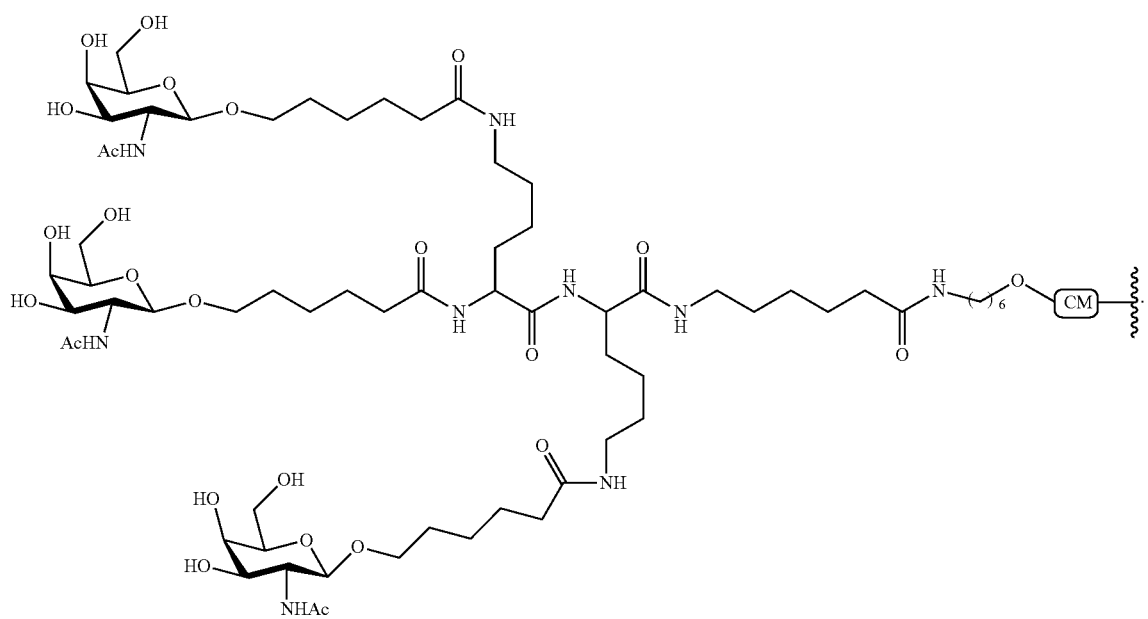
In certain such embodiments, conjugate groups have the following structure:

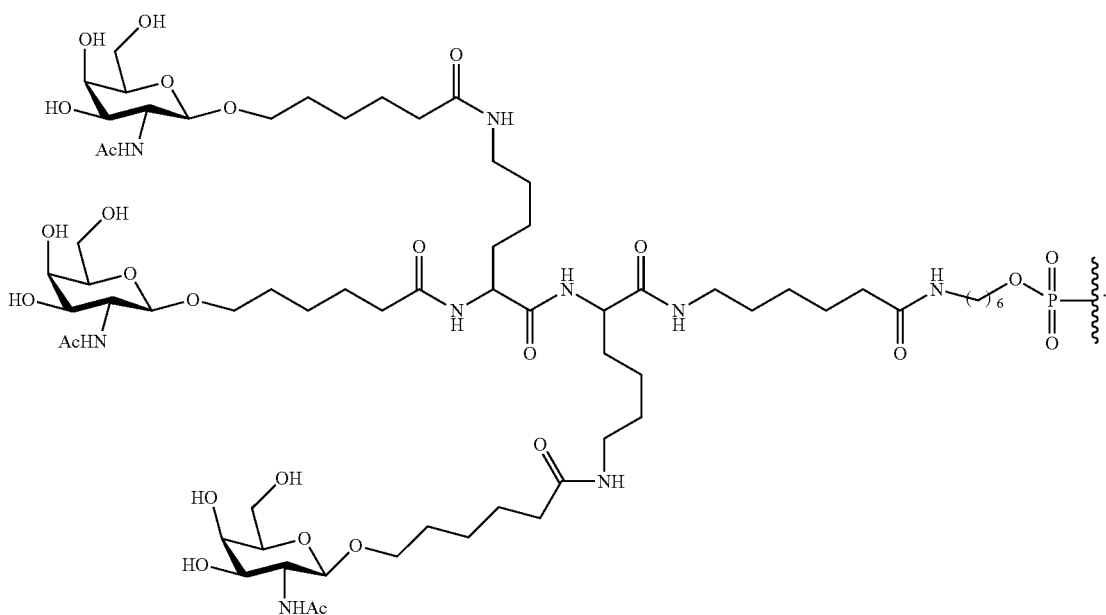
In certain such embodiments, conjugate groups have the following structure:
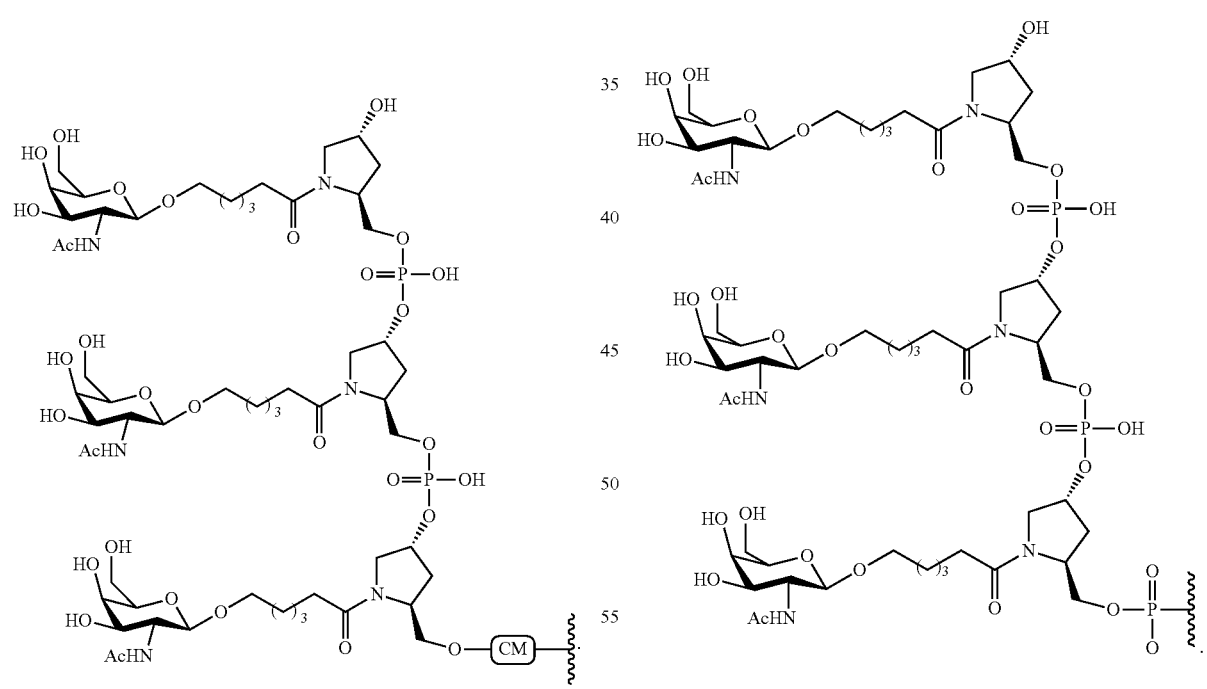
In certain such embodiments, conjugate groups have the following structure:
In certain embodiments, the cell-targeting moiety of the conjugate group has the following structure:

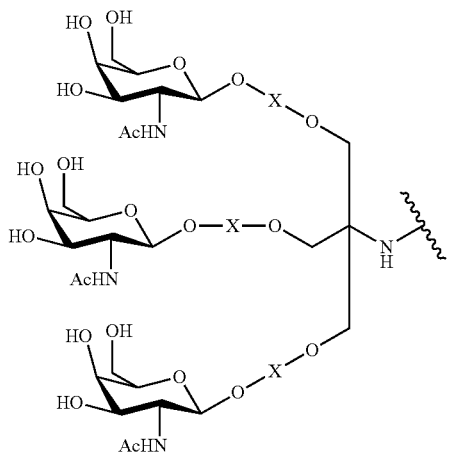

wherein X is a substituted or unsubstituted tether of six to eleven consecutively bonded atoms.

In certain embodiments, the cell-targeting moiety of the conjugate group has the following structure:

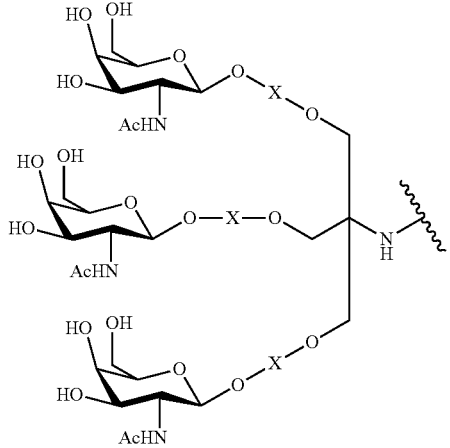

wherein X is a substituted or unsubstituted tether of ten consecutively bonded atoms.

In certain embodiments, the cell-targeting moiety of the conjugate group has the following structure:

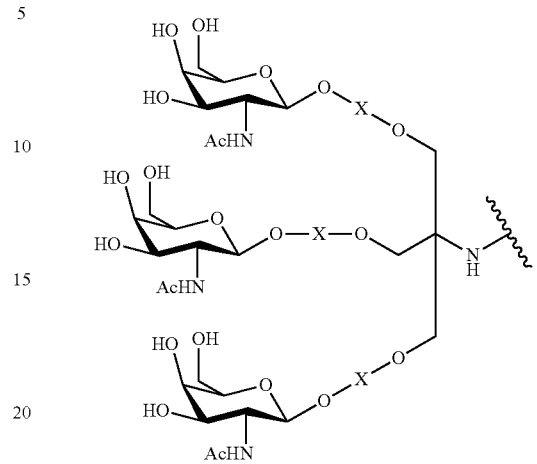

wherein X is a substituted or unsubstituted tether of four to eleven consecutively bonded atoms and wherein the tether comprises exactly one amide bond.

In certain embodiments, the cell-targeting moiety of the conjugate group has the following structure:

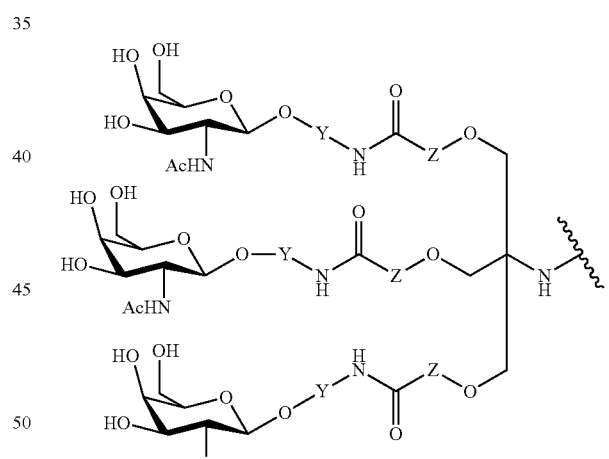

wherein Y and Z are independently selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

In certain such embodiments, the cell-targeting moiety of the conjugate group has the following structure:

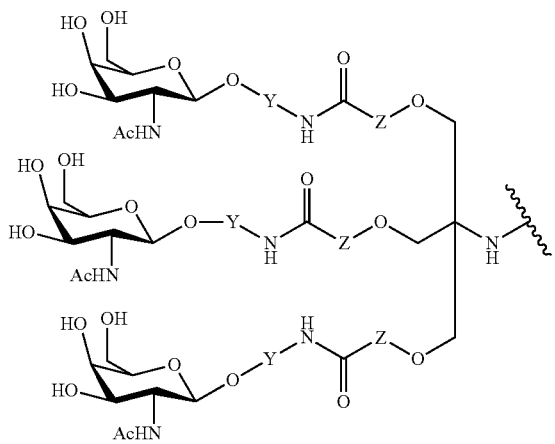

wherein Y and Z are independently selected from a $C_1$-$C_{12}$ substituted or unsubstituted alkyl group, or a group comprising exactly one ether or exactly two ethers, an amide, an amine, a piperidine, a phosphate, a phosphodiester, or a phosphorothioate.

In certain such embodiments, the cell-targeting moiety of the conjugate group has the following structure:

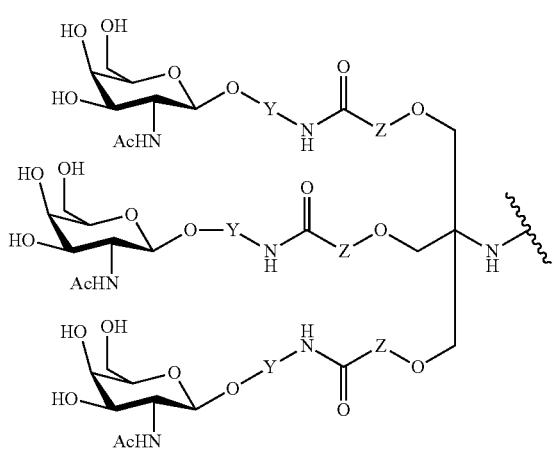

wherein Y and Z are independently selected from a $C_1$-$C_{12}$ substituted or unsubstituted alkyl group.

In certain such embodiments, the cell-targeting moiety of the conjugate group has the following structure:

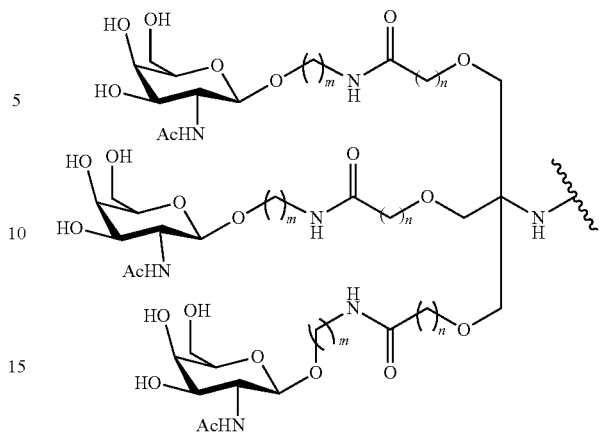

wherein m and n are independently selected from 1, 2, 3, 4, 5, 6, 7, 8, 9, 10, 11, and 12.

In certain such embodiments, the cell-targeting moiety of the conjugate group has the following structure:

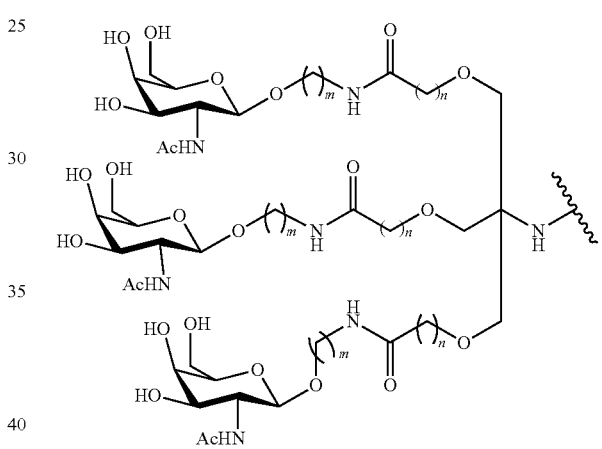

wherein m is 4, 5, 6, 7, or 8, and n is 1, 2, 3, or 4.

In certain embodiments, the cell-targeting moiety of the conjugate group has the following structure:

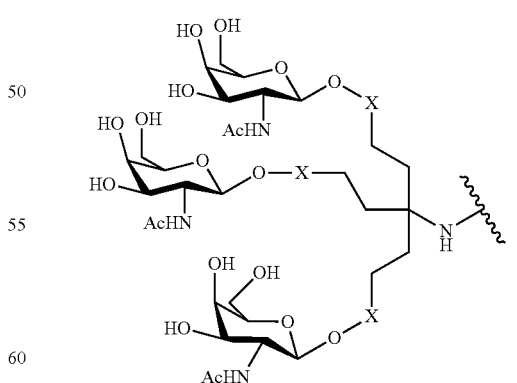

wherein X is a substituted or unsubstituted tether of four to thirteen consecutively bonded atoms, and wherein X does not comprise an ether group.

In certain embodiments, the cell-targeting moiety of the conjugate group has the following structure:

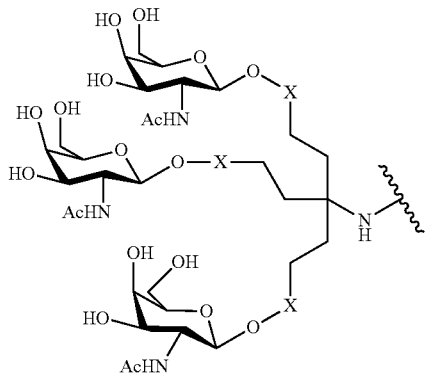

wherein X is a substituted or unsubstituted tether of eight consecutively bonded atoms, and wherein X does not comprise an ether group.

In certain embodiments, the cell-targeting moiety of the conjugate group has the following structure:

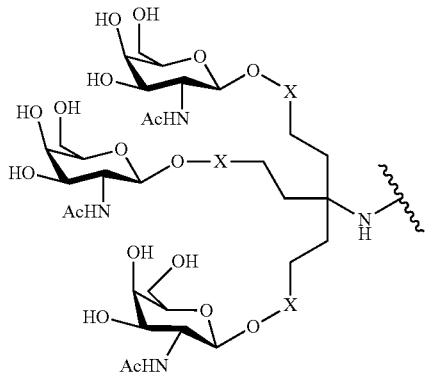

wherein X is a substituted or unsubstituted tether of four to thirteen consecutively bonded atoms, and wherein the tether comprises exactly one amide bond, and wherein X does not comprise an ether group.

In certain embodiments, the cell-targeting moiety of the conjugate group has the following structure:

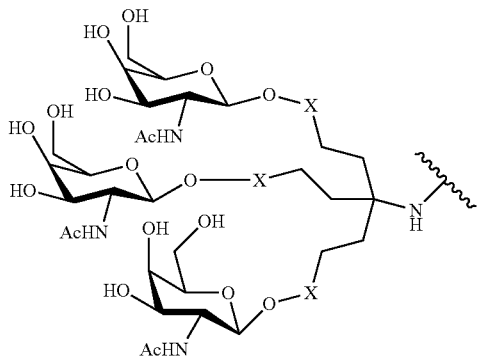

wherein X is a substituted or unsubstituted tether of four to thirteen consecutively bonded atoms and wherein the tether consists of an amide bond and a substituted or unsubstituted $C_2$-$C_{11}$ alkyl group.

In certain embodiments, the cell-targeting moiety of the conjugate group has the following structure:

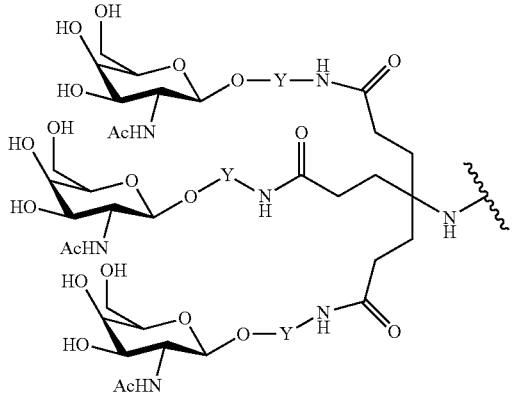

wherein Y is selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

In certain such embodiments, the cell-targeting moiety of the conjugate group has the following structure:

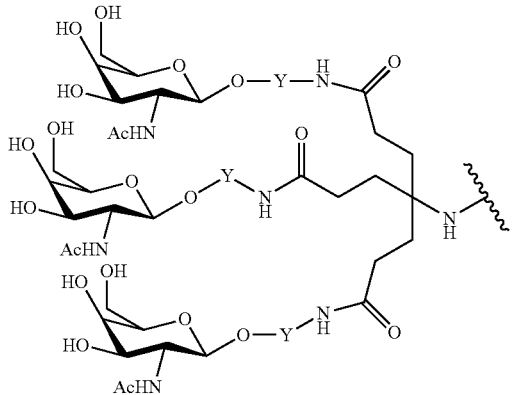

wherein Y is selected from a $C_1$-$C_{12}$ substituted or unsubstituted alkyl group, or a group comprising an ether, an amine, a piperidine, a phosphate, a phosphodiester, or a phosphorothioate.

In certain such embodiments, the cell-targeting moiety of the conjugate group has the following structure:

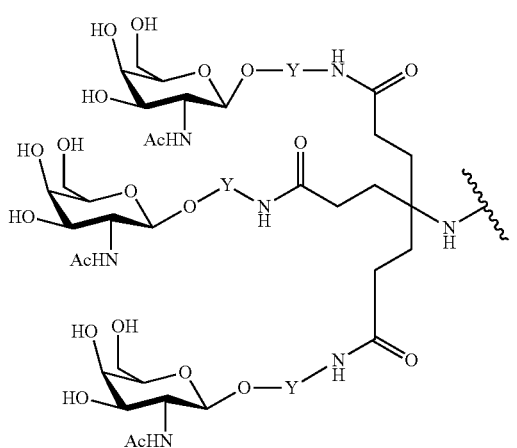

wherein Y is selected from a $C_1$-$C_{12}$ substituted or unsubstituted alkyl group.

In certain such embodiments, the cell-targeting moiety of the conjugate group has the following structure:

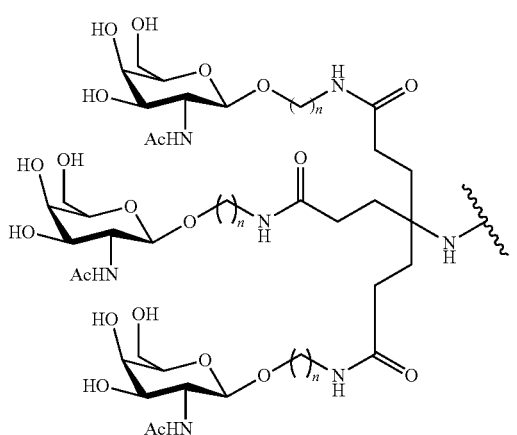

Wherein n is 1, 2, 3, 4, 5, 6, 7, 8, 9, 10, 11, or 12.

In certain such embodiments, the cell-targeting moiety of the conjugate group has the following structure:

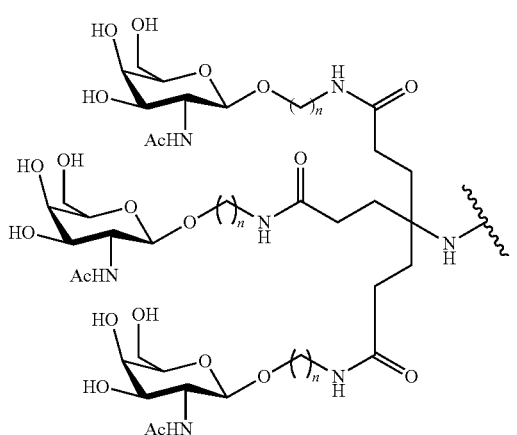

wherein n is 4, 5, 6, 7, or 8.

a Certain Conjugated Antisense Compounds

In certain embodiments, the conjugates are bound to a nucleoside of the antisense oligonucleotide at the 2',3', of 5' position of the nucleoside. In certain embodiments, a conjugated antisense compound has the following structure:

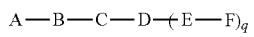

wherein
A is the antisense oligonucleotide;
B is the cleavable moiety
C is the conjugate linker
D is the branching group
each E is a tether;
each F is a ligand; and
q is an integer between 1 and 5.

In certain embodiments, a conjugated antisense compound has the following structure:

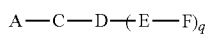

wherein
A is the antisense oligonucleotide;
C is the conjugate linker
D is the branching group
each E is a tether;
each F is a ligand; and
q is an integer between 1 and 5.

In certain such embodiments, the conjugate linker comprises at least one cleavable bond.

In certain such embodiments, the branching group comprises at least one cleavable bond.

In certain embodiments each tether comprises at least one cleavable bond.

In certain embodiments, the conjugates are bound to a nucleoside of the antisense oligonucleotide at the 2', 3', of 5' position of the nucleoside.

In certain embodiments, a conjugated antisense compound has the following structure:

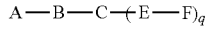

wherein
A is the antisense oligonucleotide;
B is the cleavable moiety
C is the conjugate linker
each E is a tether;
each F is a ligand; and
q is an integer between 1 and 5.

In certain embodiments, the conjugates are bound to a nucleoside of the antisense oligonucleotide at the 2', 3', of 5' position of the nucleoside. In certain embodiments, a conjugated antisense compound has the following structure:

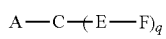

wherein
A is the antisense oligonucleotide;
C is the conjugate linker
each E is a tether;

each F is a ligand; and
q is an integer between 1 and 5.

In certain embodiments, a conjugated antisense compound has the following structure:

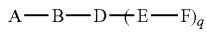

wherein
A is the antisense oligonucleotide;
B is the cleavable moiety
D is the branching group
each E is a tether;
each F is a ligand; and
q is an integer between 1 and 5.

In certain embodiments, a conjugated antisense compound has the following structure:

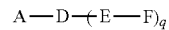

wherein
A is the antisense oligonucleotide;
D is the branching group
each E is a tether;
each F is a ligand; and
q is an integer between 1 and 5.

In certain such embodiments, the conjugate linker comprises at least one cleavable bond.

In certain embodiments each tether comprises at least one cleavable bond.

In certain embodiments, a conjugated antisense compound has a structure selected from among the following:

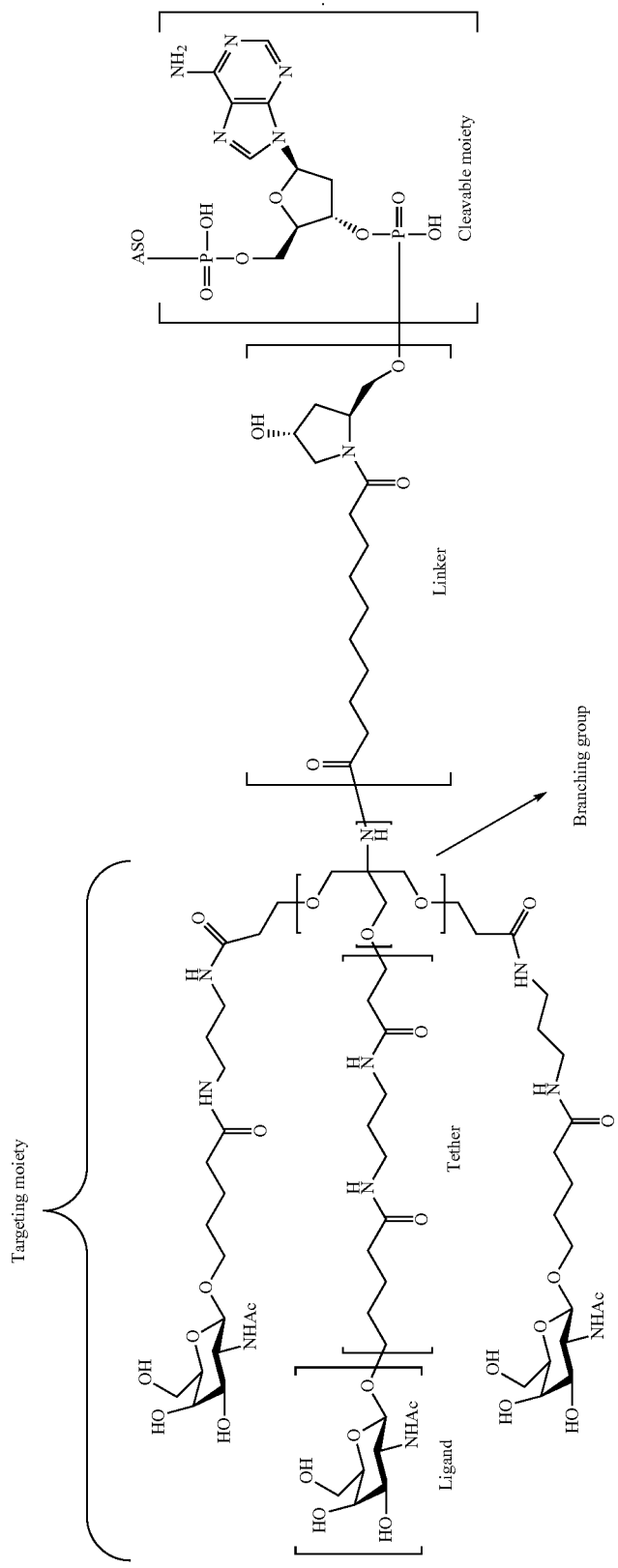

In certain embodiments, a conjugated antisense compound has a structure selected from among the following:
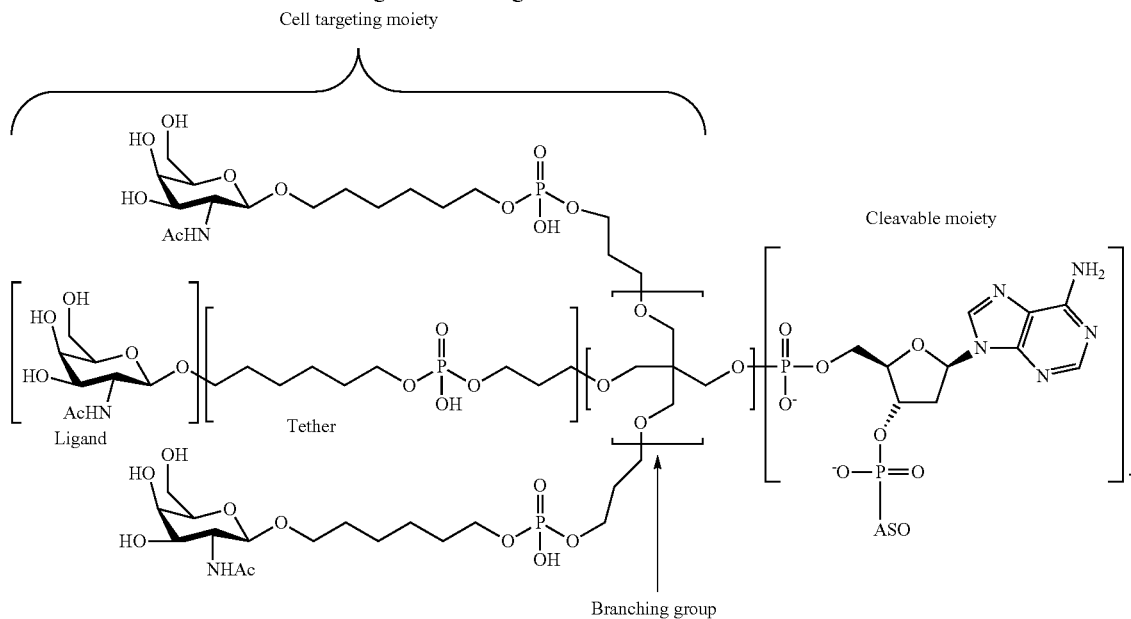
In certain embodiments, a conjugated antisense compound has a structure selected from among the following:
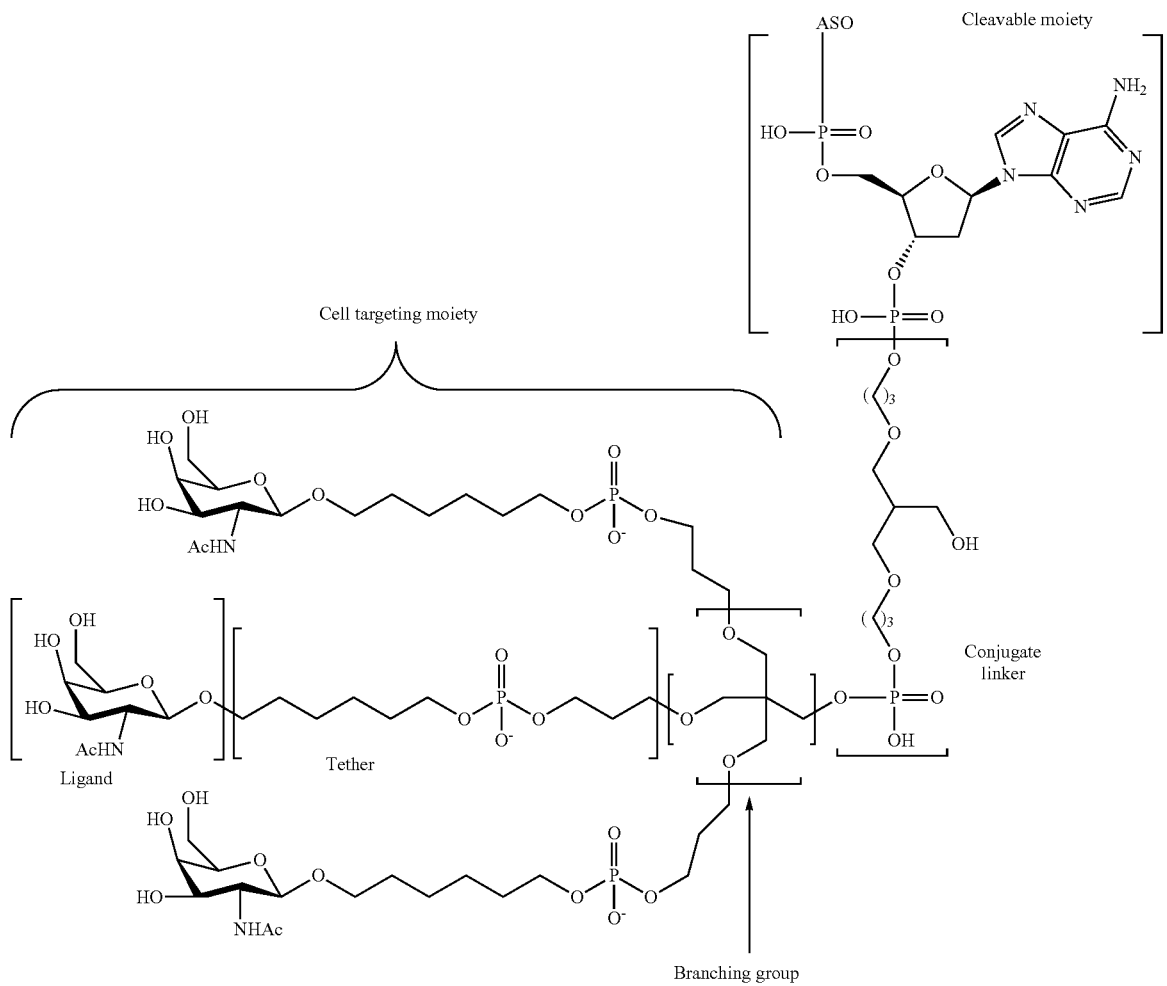

Representative United States patents, United States patent application publications, and international patent application publications that teach the preparation of certain of the above noted conjugates, conjugated antisense compounds, tethers, linkers, branching groups, ligands, cleavable moieties as well as other modifications include without limitation, U.S. Pat. Nos. 5,994,517, 6,300,319, 6,660,720, 6,906,182, 7,262,177, 7,491,805, 8,106,022, 7,723,509, US 2006/0148740, US 2011/0123520, WO 2013/033230 and WO 2012/037254, each of which is incorporated by reference herein in its entirety.

Representative publications that teach the preparation of certain of the above noted conjugates, conjugated antisense compounds, tethers, linkers, branching groups, ligands, cleavable moieties as well as other modifications include without limitation, BIESSEN et al., "The Cholesterol Derivative of a Triantennary Galactoside with High Affinity for the Hepatic Asialoglycoprotein Receptor: a Potent Cholesterol Lowering Agent" J. Med. Chem. (1995) 38:1846-1852, BIESSEN et al., "Synthesis of Cluster Galactosides with High Affinity for the Hepatic Asialoglycoprotein Receptor" J. Med. Chem. (1995) 38:1538-1546, LEE et al., "New and more efficient multivalent glyco-ligands for asialoglycoprotein receptor of mammalian hepatocytes" Bioorganic & Medicinal Chemistry (2011) 19:2494-2500, RENSEN et al., "Determination of the Upper Size Limit for Uptake and Processing of Ligands by the Asialoglycoprotein Receptor on Hepatocytes in Vitro and in Vivo" J. Biol. Chem. (2001) 276(40):37577-37584, RENSEN et al., "Design and Synthesis of Novel N-Acetylgalactosamine-Terminated Glycolipids for Targeting of Lipoproteins to the Hepatic Asialoglycoprotein Receptor" J. Med. Chem. (2004) 47:5798-5808, SLIEDREGT et al., "Design and Synthesis of Novel Amphiphilic Dendritic Galactosides for Selective Targeting of Liposomes to the Hepatic Asialoglycoprotein Receptor" J. Med. Chem. (1999) 42:609-618, and Valentijn et al., "Solid-phase synthesis of lysine-based cluster galactosides with high affinity for the Asialoglycoprotein Receptor" Tetrahedron, 1997, 53(2), 759-770, each of which is incorporated by reference herein in its entirety.

In certain embodiments, conjugated antisense compounds comprise an RNase H based oligonucleotide (such as a gapmer) or a splice modulating oligonucleotide (such as a fully modified oligonucleotide) and any conjugate group comprising at least one, two, or three GalNAc groups. In certain embodiments a conjugated antisense compound comprises any conjugate group found in any of the following references: Lee, *Carbohydr Res*, 1978, 67, 509-514; Connolly et al., *J Biol Chem*, 1982, 257, 939-945; Pavia et al., *Int J Pep Protein Res*, 1983, 22, 539-548; Lee et al., *Biochem*, 1984, 23, 4255-4261; Lee et al., *Glycoconjugate J*, 1987, 4, 317-328; Toyokuni et al., *Tetrahedron Lett*, 1990, 31, 2673-2676; Biessen et al., *J Med Chem*, 1995, 38, 1538-1546; Valentijn et al., *Tetrahedron*, 1997, 53, 759-770; Kim et al., *Tetrahedron Lett*, 1997, 38, 3487-3490; Lee et al., *Bioconjug Chem*, 1997, 8, 762-765; Kato et al., *Glycobiol*, 2001, 11, 821-829; Rensen et al., *J Biol Chem*, 2001, 276, 37577-37584; Lee et al., *Methods Enzymol*, 2003, 362, 38-43; Westerlind et al., *Glycoconj J*, 2004, 21, 227-241; Lee et al., *Bioorg Med Chem Lett*, 2006, 16(19), 5132-5135; Maierhofer et al., *Bioorg Med Chem*, 2007, 15, 7661-7676; Khorev et al., *Bioorg Med Chem*, 2008, 16, 5216-5231; Lee et al., *Bioorg Med Chem*, 2011, 19, 2494-2500; Kornilova et al., *Analyt Biochem*, 2012, 425, 43-46; Pujol et al., *Angew Chemie Int Ed Engl*, 2012, 51, 7445-7448; Biessen et al., *J Med Chem*, 1995, 38, 1846-1852; Sliedregt et al., *J Med Chem*, 1999, 42, 609-618; Rensen et al., *J Med Chem*, 2004, 47, 5798-5808; Rensen et al., *Arterioscler Thromb Vasc Biol*, 2006, 26, 169-175; van Rossenberg et al., *Gene Ther*, 2004, 11, 457-464; Sato et al., *J Am Chem Soc*, 2004, 126, 14013-14022; Lee et al., *J Org Chem*, 2012, 77, 7564-7571; Biessen et al., *FASEB J*, 2000, 14, 1784-1792; Rajur et al., *Bioconjug Chem*, 1997, 8, 935-940; Duff et al., *Methods Enzymol*, 2000, 313, 297-321; Maier et al., *Bioconjug Chem*, 2003, 14, 18-29; Jayaprakash et al., *Org Lett*, 2010, 12, 5410-5413; Manoharan, *Antisense Nucleic Acid Drug Dev*, 2002, 12, 103-128; Merwin et al., *Bioconjug Chem*, 1994, 5, 612-620; Tomiya et al., *Bioorg Med Chem*, 2013, 21, 5275-5281; International applications WO1998/013381; WO2011/038356; WO1997/046098; WO2008/098788; WO2004/101619; WO2012/037254; WO2011/120053; WO2011/100131; WO2011/163121; WO2012/177947; WO2013/033230; WO2013/075035; WO2012/083185; WO2012/083046; WO2009/082607; WO2009/134487; WO2010/144740; WO2010/148013; WO1997/020563; WO2010/088537; WO2002/043771; WO2010/129709; WO2012/068187; WO2009/126933; WO2004/024757; WO2010/054406; WO2012/089352; WO2012/089602; WO2013/166121; WO2013/165816; U.S. Pat. Nos. 4,751,219; 8,552,163; 6,908,903; 7,262,177; 5,994,517; 6,300,319; 8,106,022; 7,491,805; 7,491,805; 7,582,744; 8,137,695; 6,383,812; 6,525,031; 6,660,720; 7,723,509; 8,541,548; 8,344,125; 8,313,772; 8,349,308; 8,450,467; 8,501,930; 8,158,601; 7,262,177; 6,906,182; 6,620,916; 8,435,491; 8,404,862; 7,851,615; Published U.S. Patent Application Publications US2011/0097264; US2011/0097265; US2013/0004427; US2005/0164235; US2006/0148740; US2008/0281044; US2010/0240730; US2003/0119724; US2006/0183886; US2008/0206869; US2011/0269814; US2009/0286973; US2011/0207799; US2012/0136042; US2012/0165393; US2008/0281041; US2009/0203135; US2012/0035115; US2012/0095075; US2012/0101148; US2012/0128760; US2012/0157509; US2012/0230938; US2013/0109817; US2013/0121954; US2013/0178512; US2013/0236968; US2011/0123520; US2003/0077829; US2008/0108801; and US2009/0203132; each of which is incorporated by reference in its entirety.

Cell Culture and Antisense Compounds Treatment

The effects of antisense compounds on the level, activity, or expression of PKK nucleic acids can be tested in vitro in a variety of cell types. Cell types used for such analyses are available from commercial vendors (e.g., American Type Culture Collection, Manassas, Va.; Zen-Bio, Inc., Research Triangle Park, N.C.; Clonetics Corporation, Walkersville, Md.) and are cultured according to the vendor's instructions using commercially available reagents (e.g., Life Technologies, Carlsbad, Calif.). Illustrative cell types include, but are not limited to, HepaRG™T cells and mouse primary hepatocytes.

In Vitro Testing of Antisense Oligonucleotides

Described herein are methods for treatment of cells with antisense oligonucleotides, which can be modified appropriately for treatment with other antisense compounds.

Cells may be treated with antisense oligonucleotides when the cells reach approximately 60-80% confluency in culture.

One reagent commonly used to introduce antisense oligonucleotides into cultured cells includes the cationic lipid transfection reagent LIPOFECTIN (Life Technologies, Carlsbad, Calif.). Antisense oligonucleotides may be mixed with LIPOFECTIN in OPTI-MEM 1 (Life Technologies, Carlsbad, Calif.) to achieve the desired final concentration of antisense oligonucleotide and a LIPOFECTIN concentration that may range from 2 to 12 ug/mL per 100 nM antisense oligonucleotide.

Another reagent used to introduce antisense oligonucleotides into cultured cells includes LIPOFECTAMINE (Life Technologies, Carlsbad, Calif.). Antisense oligonucleotide is mixed with LIPOFECTAMINE in OPTI-MEM 1 reduced serum medium (Life Technologies, Carlsbad, Calif.) to achieve the desired concentration of antisense oligonucleotide and a LIPOFECTAMINE concentration that may range from 2 to 12 ug/mL per 100 nM antisense oligonucleotide.

Another technique used to introduce antisense oligonucleotides into cultured cells includes electroporation.

Yet another technique used to introduce antisense oligonucleotides into cultured cells includes free uptake of the oligonucleotides by the cells.

Cells are treated with antisense oligonucleotides by routine methods. Cells may be harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE. Antisense oligonucleotides are used at higher concentrations ranging from 625 to 20,000 nM when transfected using electroporation.

RNA Isolation

RNA analysis can be performed on total cellular RNA or poly(A)+ mRNA. Methods of RNA isolation are well known in the art. RNA is prepared using methods well known in the art, for example, using the TRIZOL Reagent (Life Technologies, Carlsbad, Calif.) according to the manufacturer's recommended protocols.

Analysis of Inhibition of Target Levels or Expression

Inhibition of levels or expression of a PKK nucleic acid can be assayed in a variety of ways known in the art. For example, target nucleic acid levels can be quantitated by, e.g., Northern blot analysis, competitive polymerase chain reaction (PCR), or quantitative real-time PCR. RNA analysis can be performed on total cellular RNA or poly(A)+ mRNA. Methods of RNA isolation are well known in the art. Northern blot analysis is also routine in the art. Quantitative real-time PCR can be conveniently accomplished using the commercially available ABI PRISM 7600, 7700, or 7900 Sequence Detection System, available from PE-Applied Biosystems, Foster City, Calif. and used according to manufacturer's instructions.

Quantitative Real-Time PCR Analysis of Target RNA Levels

Quantitation of target RNA levels may be accomplished by quantitative real-time PCR using the ABI PRISM 7600, 7700, or 7900 Sequence Detection System (PE-Applied Biosystems, Foster City, Calif.) according to manufacturer's instructions. Methods of quantitative real-time PCR are well known in the art.

Prior to real-time PCR, the isolated RNA is subjected to a reverse transcriptase (RT) reaction, which produces complementary DNA (cDNA) that is then used as the substrate for the real-time PCR amplification. The RT and real-time PCR reactions are performed sequentially in the same sample well. RT and real-time PCR reagents may be obtained from Life Technologies (Carlsbad, Calif.). RT real-time-PCR reactions are carried out by methods well known to those skilled in the art.

Gene (or RNA) target quantities obtained by real time PCR are normalized using either the expression level of a gene whose expression is constant, such as cyclophilin A, or by quantifying total RNA using RIBOGREEN (Life Technologies, Inc. Carlsbad, Calif.). Cyclophilin A expression is quantified by real time PCR, by being run simultaneously with the target, multiplexing, or separately. Total RNA is quantified using RIBOGREEN RNA quantification reagent (Invitrogen, Inc. Eugene, Oreg.). Methods of RNA quantification by RIBOGREEN are taught in Jones, L. J., et al, (Analytical Biochemistry, 1998, 265, 368-374). A CYTOFLUOR 4000 instrument (PE Applied Biosystems) is used to measure RIBOGREEN fluorescence.

Probes and primers are designed to hybridize to a PKK nucleic acid. Methods for designing real-time PCR probes and primers are well known in the art, and may include the use of software such as PRIMER EXPRESS Software (Applied Biosystems, Foster City, Calif.).

Analysis of Protein Levels

Antisense inhibition of PKK nucleic acids can be assessed by measuring PKK protein levels. Protein levels of PKK can be evaluated or quantitated in a variety of ways well known in the art, such as immunoprecipitation, Western blot analysis (immunoblotting), enzyme-linked immunosorbent assay (ELISA), quantitative protein assays, protein activity assays (for example, caspase activity assays), immunohistochemistry, immunocytochemistry or fluorescence-activated cell sorting (FACS). Antibodies directed to a target can be identified and obtained from a variety of sources, such as the MSRS catalog of antibodies (Aerie Corporation, Birmingham, Mich.), or can be prepared via conventional monoclonal or polyclonal antibody generation methods well known in the art.

In Vivo Testing of Antisense Compounds

Antisense compounds, for example, antisense oligonucleotides, are tested in animals to assess their ability to inhibit expression of PKK and produce phenotypic changes.

In certain embodiments, such phenotypic changes include those associated with an inflammatory disease, such as, reduced inflammation, edema/swelling, vascular permeability, and vascular leakage. In certain embodiments, inflammation is measured by measuring the increase or decrease of edema, temperature, pain, color of tissue, and abdominal function in the animal.

In certain embodiments, such phenotypic changes include those associated with a thromboembolic disease, such as, prolonged aPTT, prolonged aPTT time in conjunction with a normal PT, decreased quantity of Platelet Factor 4 (PF-4), and reduced formation of thrombus or increased time for thrombus formation.

Testing may be performed in normal animals, or in experimental disease models. For administration to animals, antisense oligonucleotides are formulated in a pharmaceutically acceptable diluent, such as phosphate-buffered saline. Administration includes parenteral routes of administration, such as intraperitoneal, intravenous, and subcutaneous. Calculation of antisense oligonucleotide dosage and dosing frequency is within the abilities of those skilled in the art, and depends upon factors such as route of administration and animal body weight. Following a period of treatment with antisense oligonucleotides, RNA is isolated from liver tissue and changes in PKK nucleic acid expression are measured.

Certain Indications

In certain embodiments, the invention provides methods of treating an individual comprising administering one or more pharmaceutical compositions as described herein.

In certain embodiments, the individual has an inflammatory disease. In certain embodiments, the individual is at risk for developing an inflammatory condition, including, but not limited to hereditary angioedema (HAE), edema, angioedema, swelling, angioedema of the lids, ocular edema, macular edema, and cerebral edema. This includes individuals with an acquired problem, disease, or disorder that leads to a risk of inflammation, for example, genetic predisposition to an inflammatory condition, environmental factors, and exposure to certain medications, including, for example, ACE inhibitors and ARBs. In certain embodiments, the individual has been identified as in need of anti-inflammation therapy. Examples of such individuals include, but are not limited to those having a mutation in the genetic code for complement 1 esterase inhibitor (i.e., C1-INH) or Factor 12. In certain embodiments, an abnormal code can lead to a deficiency in C1-INH (i.e., type I HAE), an inability of existing C1-INH to function properly (type II HAE), or hyperfunctional Factor 12 (i.e., type III HAE).

In certain embodiments, the individual has a thromboembolic disease. In certain embodiments, the individual is at risk for a blood clotting disorder, including, but not limited to, infarct, thrombosis, embolism, thromboembolism such as deep vein thrombosis, pulmonary embolism, myocardial infarction, and stroke. This includes individuals with an acquired problem, disease, or disorder that leads to a risk of thrombosis, for example, surgery, cancer, immobility, sepsis, atherosclerosis atrial fibrillation, as well as genetic predisposition, for example, antiphospholipid syndrome and the autosomal dominant condition, Factor V Leiden. In certain embodiments, the individual has been identified as in need of anticoagulation therapy. Examples of such individuals include, but are not limited to, those undergoing major orthopedic surgery (e.g., hip/knee replacement or hip fracture surgery) and patients in need of chronic treatment, such as those suffering from arterial fibrillation to prevent stroke.

In certain embodiments the invention provides methods for prophylactically reducing PKK expression in an individual. Certain embodiments include treating an individual in need thereof by administering to an individual a therapeutically effective amount of an antisense compound targeted to a PKK nucleic acid.

In one embodiment, administration of a therapeutically effective amount of an antisense compound targeted to a PKK nucleic acid is accompanied by monitoring of PKK levels in the serum of an individual, to determine an individual's response to administration of the antisense compound. An individual's response to administration of the antisense compound is used by a physician to determine the amount and duration of therapeutic intervention.

In certain embodiments, administration of an antisense compound targeted to a PKK nucleic acid results in reduction of PKK expression by at least 15, 20, 25, 30, 35, 40, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99%, or a range defined by any two of these values. In certain embodiments, pharmaceutical compositions comprising an antisense compound targeted to PKK are used for the preparation of a medicament for treating a patient suffering or susceptible to an inflammatory disease or thromboembolic disease.

Certain Compositions
1. ISIS 546254

In certain embodiments, ISIS 546254 is characterized as a 5-10-5 MOE gapmer, having a sequence of (from 5' to 3') TGCAAGTCTCTTGGCAAACA (incorporated herein as SEQ ID NO: 570), wherein each internucleoside linkage is a phosphorothioate linkage, each cytosine is a 5'-methylcytosine, each of nucleosides 1-5 and 16-20 are 2'-O-methoxyethyl modified nucleosides, and each of nucleosides 6-15 are 2'-deoxynucleosides.

In certain embodiments, ISIS 546254 is described by the following chemical notation: Tes Ges mCes Aes Aes Gds Tds mCds Tds mCds Tds Tds Gds Gds mCds Aes Aes Aes mCes Ae; wherein,
A=an adenine,
mC=a 5'-methylcytosine
G=a guanine,
T=a thymine,
e=a 2'-O-methoxyethyl modified nucleoside,
d=a 2'-deoxynucleoside, and
s=a phosphorothioate internucleoside linkage.

In certain embodiments, ISIS 546254 is described by the following chemical structure:

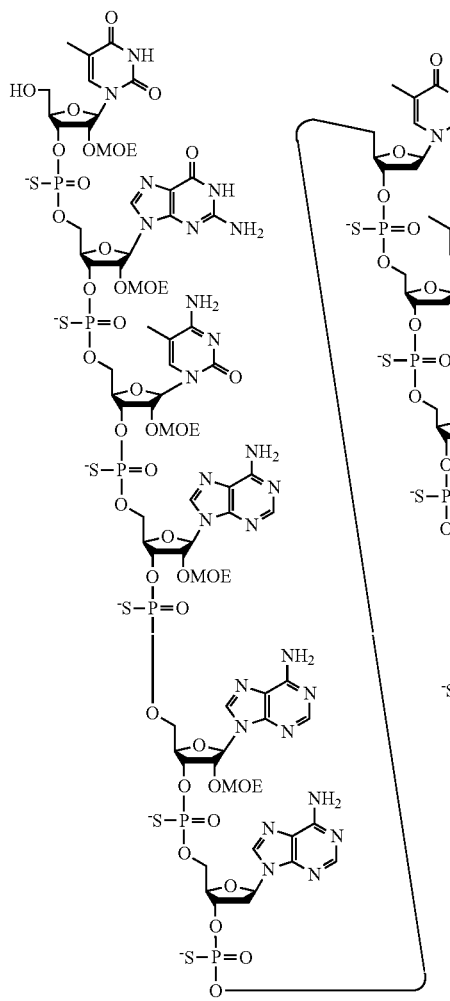

Structure 1. ISIS 546254

In certain embodiments, as provided in Example 2 (hereinbelow), ISIS 546254 achieved 950 inhibition of human PKK mRNA in cultured HepaRG™ cells (density of 20,000 cells per well) when transfected using electroporation with 5,000 nM antisense oligonucleotide after a treatment period of 24 hours and measured by quantitative real-time PCR using human primer probe set RTS3454 and adjusted according to total RNA content, as measured by RIBOGREEN®.

In certain embodiments, as provided in Example 5 (see Tables 34 and 41 hereinbelow), ISIS 546254 achieved an $IC_{50}$ of 0.2 µM and 0.3 µM in a 4 point dose response curve (0.19 µM, 0.56 µM, 1.67 µM, and 5.0 µM) in cultured HepaRG™ cells (density of 20,000 cells per well) when transfected using electroporation after a treatment period of 16 and measured by quantitative real-time PCR using human primer probe set RTS3454 and adjusted according to total RNA content, as measured by RIBOGREEN®.

In certain embodiments, as provided in Example 7 (hereinbelow), ISIS 546254 achieved 31%, 55%, 84%, and 83% human PKK mRNA inhibition and 0%, 36%, 51%, and 76% human PKK protein inhibition in transgenic mice harboring the human PKK gene sequence when injected subcutaneously twice a week for 3 weeks with 2.5 mg/kg/week, 5.0 mg/kg/week, 10 mg/kg/week or 20 mg/kg/week with ISIS 546254.

In certain embodiments, as provided in Example 8 (hereinbelow), ISIS 546254 is effective for inhibiting PKK mRNA and protein expression and is tolerable in primates.

2. ISIS 546343

In certain embodiments, ISIS 546343 is characterized as a 5-10-5 MOE gapmer, having a sequence of (from 5' to 3') CCCCCTTCTTTATAGCCAGC (incorporated herein as SEQ ID NO: 705), wherein each internucleoside linkage is a phosphorothioate linkage, each cytosine is a 5'-methylcytosine, each of nucleosides 1-5 and 16-20 are 2'-O-methoxyethyl modified nucleosides, and each of nucleosides 6-15 are 2'-deoxynucleosides.

In certain embodiments, ISIS 546343 is described by the following chemical notation: mCes mCes mCes mCes mCes Tds Tds mCds Tds Tds Tds Ads Tds Ads Gds mCes mCes Aes Ges mCe; wherein, A=an adenine,
mC=a 5'-methylcytosine;
G=a guanine,
T=a thymine,
e=a 2'-O-methoxyethyl modified nucleoside,
d=a 2'-deoxynucleoside, and
s=a phosphorothioate internucleoside linkage.

In certain embodiments, ISIS 546343 is described by the following chemical structure:

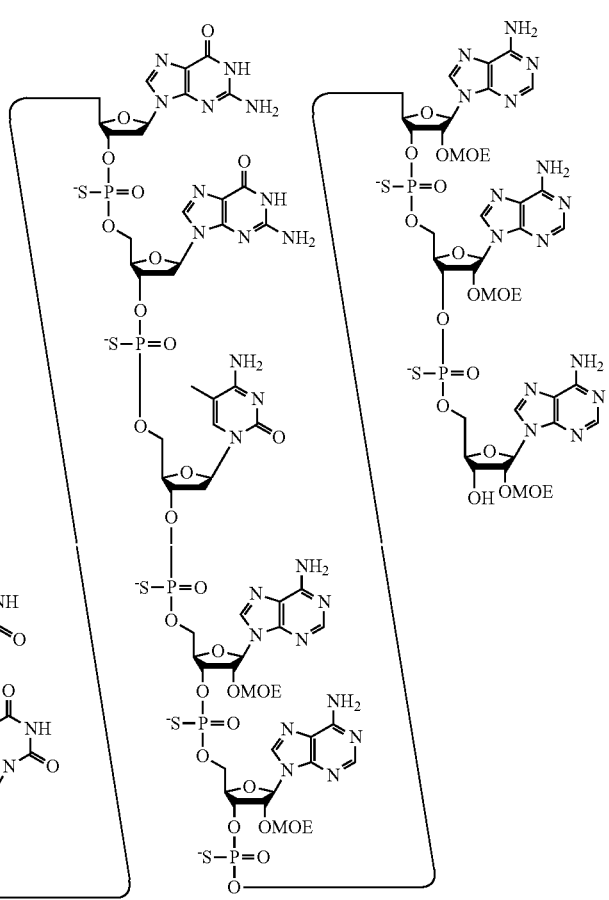

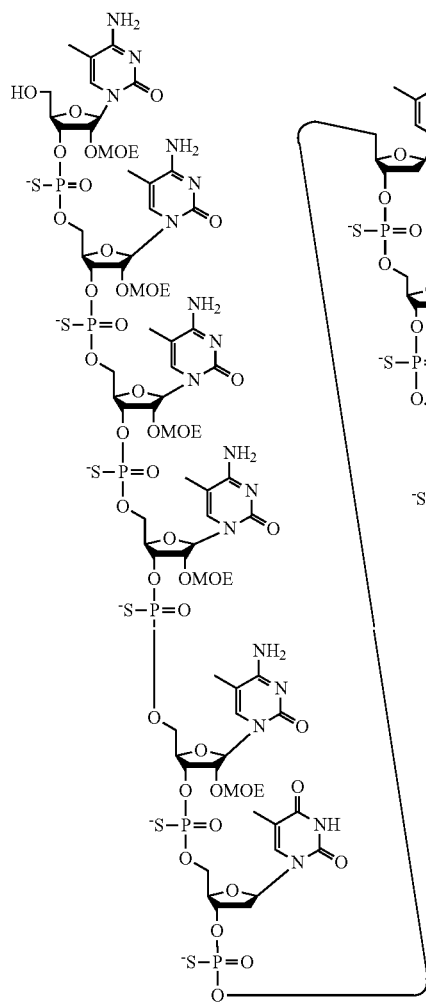
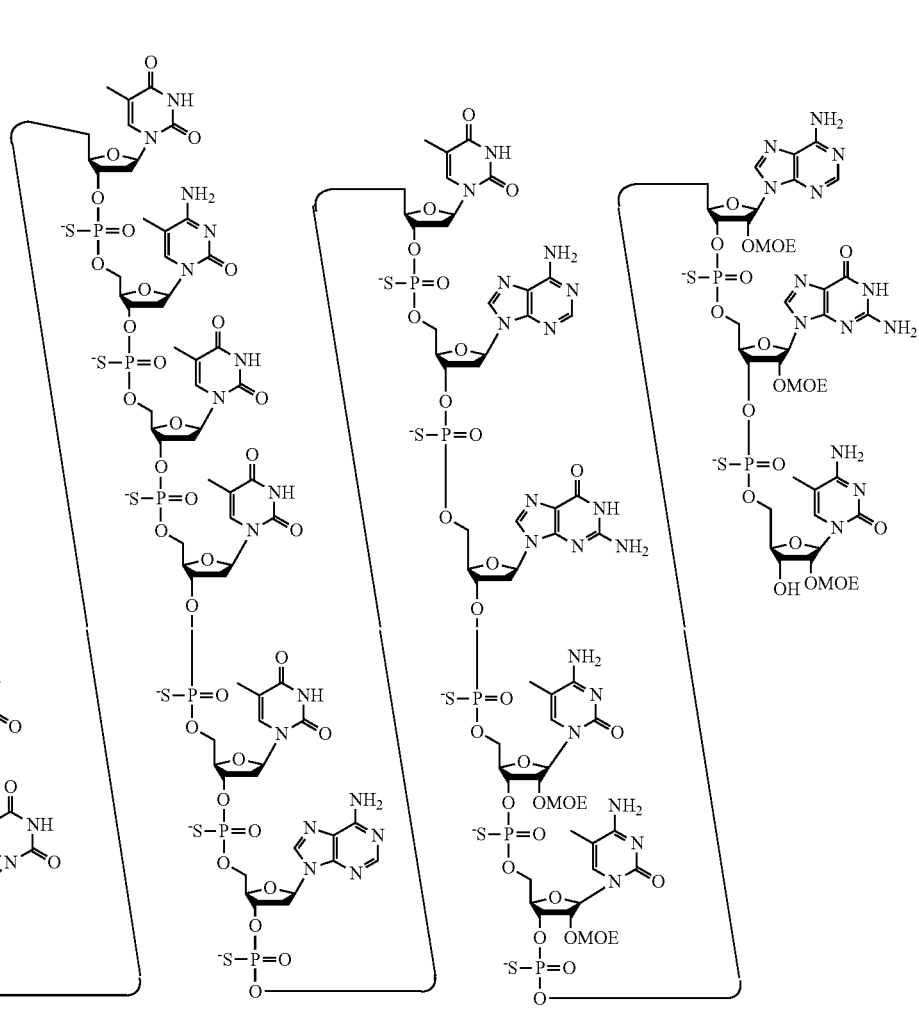

Structure 2. ISIS 546343

In certain embodiments, as provided in Example 2 (see Tables 9 and 10 hereinbelow), ISIS 546343 achieved 97% and 91% human PKK mRNA inhibition in cultured HepaRG™ cells (density of 20,000 cells per well) when transfected using electroporation with 5,000 nM antisense oligonucleotide after a treatment period of 24 hours and measured by quantitative real-time PCR using human primer probe set RTS3454 and adjusted according to total RNA content, as measured by RIBOGREEN®.

In certain embodiments, as provided twice in Example 5 (see Tables 34 and 41 hereinbelow), ISIS 546343 achieved an $IC_{50}$ of 0.4 µM in a 4 point dose response curve (0.19 µM, 0.56 µM, 1.67 µM, and 5.0 µM) in cultured HepaRG™ cells (density of 20,000 cells per well) when transfected using electroporation after a treatment period of 16 and measured by quantitative real-time PCR using human primer probe set RTS3454 and adjusted according to total RNA content, as measured by RIBOGREEN®.

In certain embodiments, as provided in Example 7 (hereinbelow), ISIS 546343 achieved 46%, 66%, and 86% human PKK mRNA inhibition and 0%, 38%, and 79% human PKK protein inhibition in transgenic mice harboring the human PKK gene sequence when injected subcutaneously twice a week for 3 weeks with 2.5 mg/kg/week, 5.0 mg/kg/week, 10 mg/kg/week or 20 mg/kg/week with ISIS 546343.

In certain embodiments, as provided in Example 8 (hereinbelow), ISIS 546343 is effective for inhibiting PKK mRNA and protein expression and is tolerable in primates.

3. ISIS 548048

In certain embodiments, ISIS 548048 is characterized as a modified antisense oligonucleotide having the nucleobase sequence (from 5' to 3') CGATATCATGATTCCC (incorporated herein as SEQ ID NO: 1666), consisting of a combination of sixteen 2'-deoxynucleosides, 2'-O-methoxyethyl modified nucleosides, and cEt modified nucleosides, wherein each of nucleosides 1, 2, and 16 are 2'-O-methoxyethyl modified nucleosides, wherein each of nucleosides 3, 14, and 15 are cEt modified nucleosides, wherein each of nucleosides 4-13 are 2'-deoxynucleosides, wherein each internucleoside linkage is a phosphorothioate internucleoside linkage, and wherein each cytosine is a 5'-methylcytosine.

In certain embodiments, ISIS 548048 is described by the following chemical notation: mCes Ges Aks Tds Ads Tds mCds Ads Tds Gds Ads Tds Tds mCks mCks mCe; wherein,
A=an adenine,
mC=a 5'-methylcytosine;
G=a guanine,
T=a thymine,
e=a 2'-O-methoxyethyl modified nucleoside,
k=a cEt modified nucleoside, d=a 2'-deoxynucleoside, and
s=a phosphorothioate internucleoside linkage.

In certain embodiments, ISIS 548048 is described by the following chemical structure:

In certain embodiments, as provided in Example 6 (hereinbelow), ISIS 548048 achieved an IC$_{50}$ of 0.1 µM in a 4 point dose response curve (0.11 µM, 0.33 µM, 1.00 µM, and

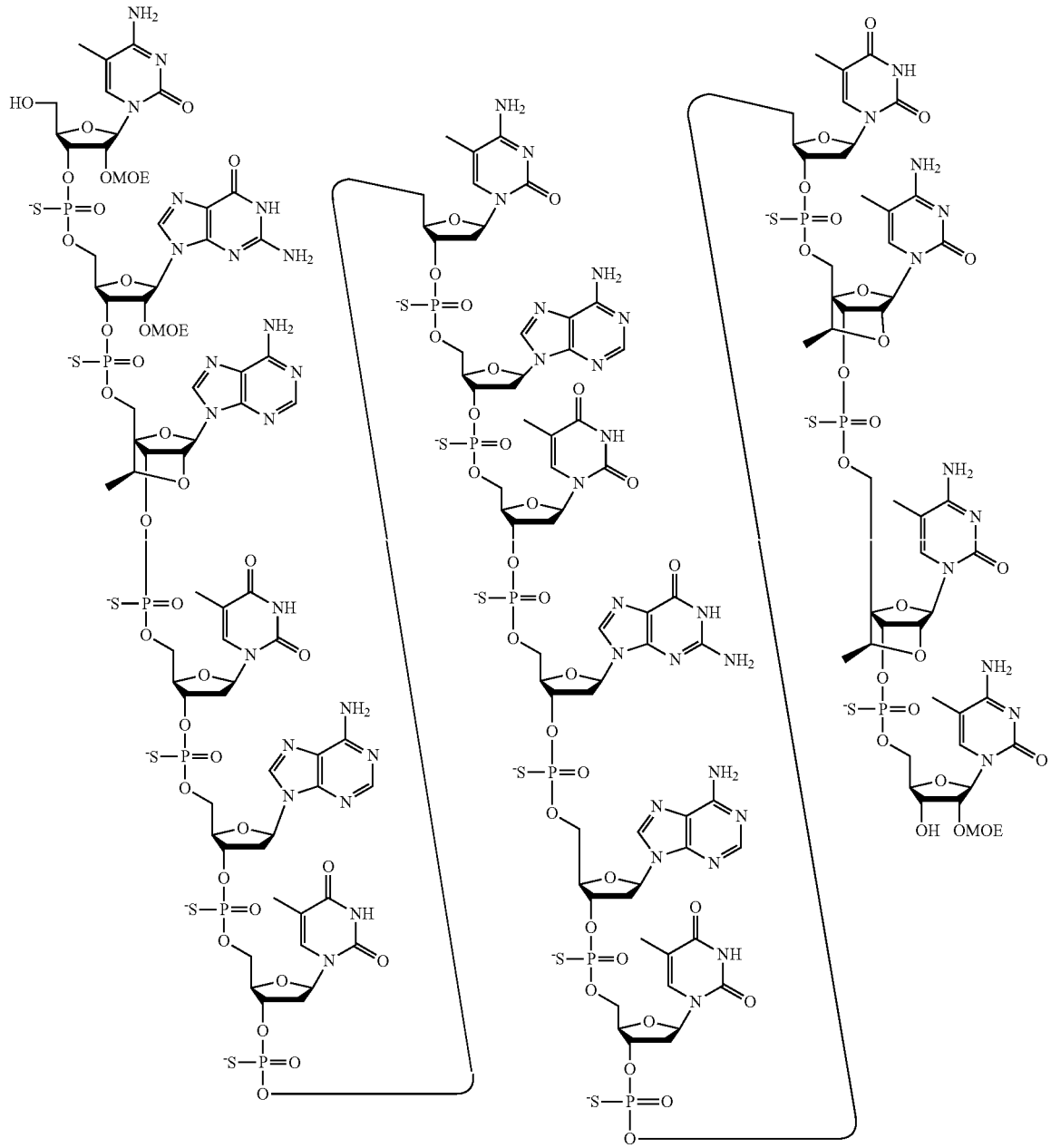

Structure 3. ISIS 548048

In certain embodiments, as provided in Example 3 (hereinbelow), ISIS 548048 achieved 84% mRNA inhibition in cultured HepaRG™ cells (density of 20,000 cells per well) when transfected using electroporation with 1,000 nM antisense oligonucleotide after a treatment period of 24 hours and measured by quantitative real-time PCR using human primer probe set RTS3454 and adjusted according to total RNA content, as measured by RIBOGREEN®.

3.00 µM) in cultured HepaRG™ cells (density of 20,000 cells per well) when transfected using electroporation after a treatment period of 16 and measured by quantitative real-time PCR using human primer probe set RTS3454 and adjusted according to total RNA content, as measured by RIBOGREEN®.

In certain embodiments, as provided in Example 7 (hereinbelow), ISIS 548048 achieved 7%, 77%, 72% and 80% human PKK mRNA inhibition and 23%, 70%, 89%, and 98% human PKK protein inhibition in transgenic mice harboring the human PKK gene sequence when injected subcutaneously twice a week for 3 weeks with 2.5 mg/kg/week, 5.0 mg/kg/week, 10 mg/kg/week or 20 mg/kg/week with ISIS 548048.

In certain embodiments, as provided in Example 8 (hereinbelow), ISIS 548048 is effective for inhibiting PKK mRNA and protein expression and is tolerable in primates.

4. ISIS 721744

In certain embodiments, ISIS 721744 is characterized as a 5-10-5 MOE gapmer, having a sequence of (from 5' to 3') TGCAAGTCTCTTGGCAAACA (incorporated herein as SEQ ID NO: 570), wherein the internucleoside linkages between nucleosides 3 to 4, 4 to 5, 16 to 17, and 17 to 18 are phosphodiester linkages and the internucleoside linkages between nucleosides 1 to 2, 2 to 3, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate linkages, each cytosine is a 5'-methylcytosine, each of nucleosides 1-5 and 16-20 are 2'-O-methoxyethyl modified nucleosides, and each of nucleosides 6-15 are 2'-deoxynucleosides.

In certain embodiments, ISIS 721744 is described by the following chemical notation: GalNAc3-7$_{a\text{-}o'}$Tes Ges mCeo Aeo Aes Gds Tds mCds Tds mCds Tds Tds Gds Gds mCds Aeo Aeo Aes mCes Ae; wherein, A=an adenine,
mC=a 5'-methylcytosine
G=a guanine,
T=a thymine,
e=a 2'-O-methoxyethyl modified nucleoside,
d=a 2'-deoxynucleoside,
o=a phosphodiester internucleoside linkage,
s=a phosphorothioate internucleoside linkage, and GalNAc3-7$_{a\text{-}o'}$ =

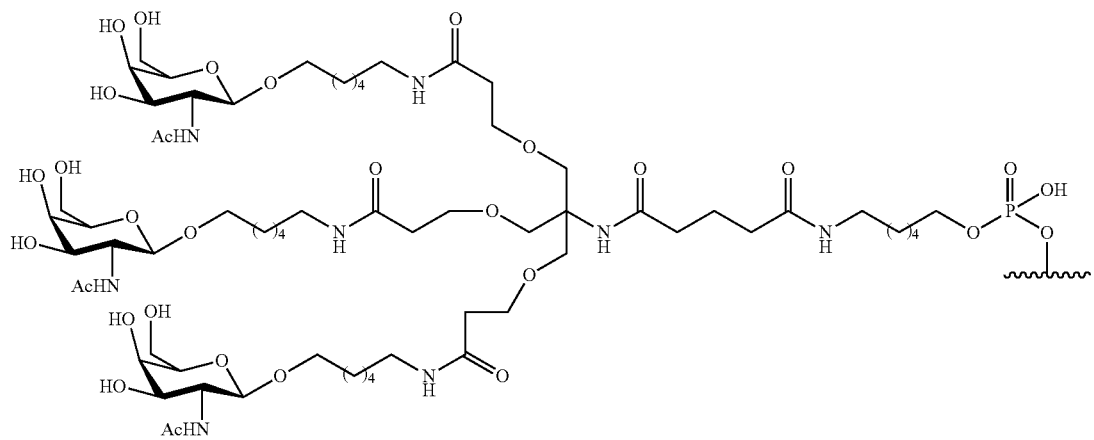

In certain embodiments, ISIS 721744 is described by the following chemical structure:
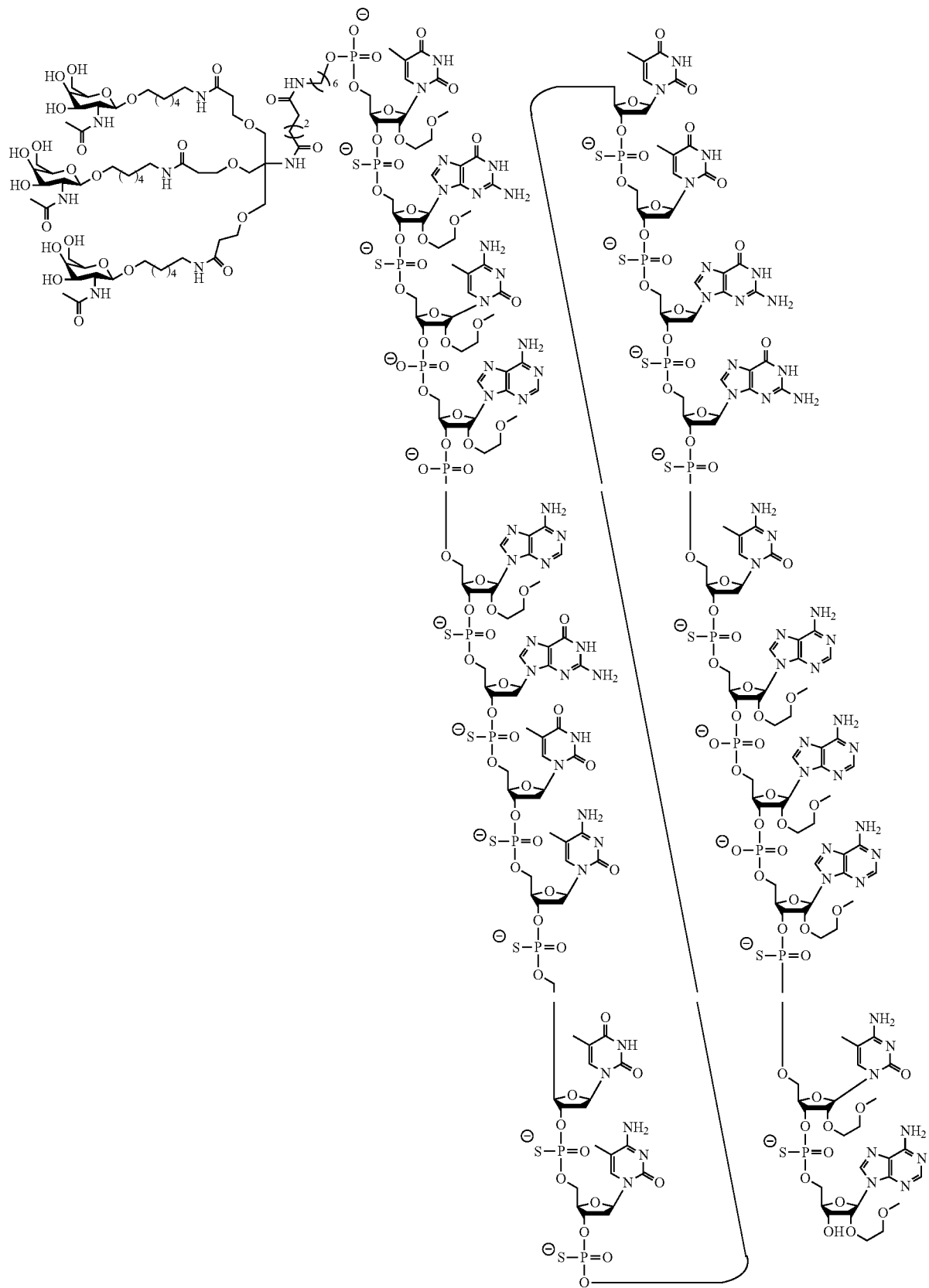

Certain Hotspot Regions

1. Nucleobases 27427-27466 of SEQ ID NO: 10

In certain embodiments, antisense oligonucleotides are designed to target nucleobases 27427-27466 of SEQ ID NO: 10 (GENBANK Accession No. NT_016354.19 truncated from nucleobases 111693001 to 11730000). In certain embodiments, nucleobases 27427-27466 of SEQ ID NO: 10 are a hotspot region. In certain embodiments, nucleobases 27427-27466 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 27427-27466 of SEQ ID NO: 10 are targeted by the following ISIS numbers: 530993, 530994, 530995, 546251, 546252, 546253, 546254, 546255, 546256, 547410, 547411, 547978, 547979, 547980, and 547981.

In certain embodiments, nucleobases 27427-27466 of SEQ ID NO: 10 are targeted by the following SEQ ID NOs: 94, 95, 96, 566, 567, 568, 569, 570, 571, 572, 573, 1597, 1598, 1599, and 1600.

In certain embodiments, antisense oligonucleotides targeting nucleobases 27427-27466 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

2. Nucleobases 33183-33242 of SEQ ID NO: 10

In certain embodiments, antisense oligonucleotides are designed to target nucleobases 33183-33242 of SEQ ID NO: 10 (GENBANK Accession No. NT_016354.19 truncated from nucleobases 111693001 to 11730000). In certain embodiments, nucleobases 33183-33242 of SEQ ID NO: 10 are a hotspot region. In certain embodiments, nucleobases 33183-33242 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 33183-33242 of SEQ ID NO: 10 are targeted by the following ISIS numbers: 531052, 531053, 531054, 531055, 531056, 531057, 531158, 546343, 546345, 547480, 547481, 547482, and 547483.

In certain embodiments, nucleobases 33183-33242 of SEQ ID NO: 10 are targeted by the following SEQ ID NOs: 155, 156, 157, 158, 159, 160, 261, 702, 703, 704, 705, 706, and 707.

In certain embodiments, antisense oligonucleotides targeting nucleobases 33183-33242 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK mRNA and/or protein levels in vitro and/or in vivo.

3. Nucleobases 30570-30610 of SEQ ID NO: 10

In certain embodiments, antisense oligonucleotides are designed to target nucleobases 30570-30610 of SEQ ID NO: 10 (GENBANK Accession No. NT_016354.19 truncated from nucleobases 111693001 to 11730000). In certain embodiments, nucleobases 30570-30610 of SEQ ID NO: 10 are a hotspot region. In certain embodiments, nucleobases 30570-30610 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 30570-30610 of SEQ ID NO: 10 are targeted by the following ISIS numbers: 531026, 546309, 546310, 546311, 546313, 547453, 547454, 547455, 547456, 547457, 547458, 548046, 548047, 548048, 548049, and 548050.

In certain embodiments, nucleobases 30570-30610 of SEQ ID NO: 10 are targeted by the following SEQ ID NOs: 129, 652, 653, 654, 655, 656, 657, 658, 659, 660, 661, 1664, 1665, 1666, 1667, and 1668.

In certain embodiments, antisense oligonucleotides targeting nucleobases 30570-30610 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK mRNA and/or protein levels in vitro and/or in vivo.

4. Nucleobases 27427-27520 of SEQ ID NO: 10

In certain embodiments, antisense oligonucleotides are designed to target nucleobases 27427-27520 of SEQ ID NO: 10 (GENBANK Accession No. NT_016354.19 truncated from nucleobases 111693001 to 11730000). In certain embodiments, nucleobases 27427-27520 of SEQ ID NO: 10 are a hotspot region. In certain embodiments, nucleobases 27427-27520 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 27427-27520 of SEQ ID NO: 10 are targeted by the following ISIS numbers: 530993-530999, 546251-546256, 546258-546260, 546263, 546265-546268, 547410-547417, and 547978-547992.

In certain embodiments, nucleobases 27427-27520 of SEQ ID NO: 10 are targeted by the following SEQ ID NOs: 94-100, 566-587, and 1597-1611.

In certain embodiments, antisense oligonucleotides targeting nucleobases 27427-27520 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

5. Nucleobases 33085-33247 of SEQ ID NO: 10

In certain embodiments, antisense oligonucleotides are designed to target nucleobases 33085-33247 of SEQ ID NO: 10 (GENBANK Accession No. NT_016354.19 truncated from nucleobases 111693001 to 11730000). In certain embodiments, nucleobases 33085-33247 of SEQ ID NO: 10 are a hotspot region. In certain embodiments, nucleobases 33085-33247 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 33085-33247 of SEQ ID NO: 10 are targeted by the following ISIS numbers: 531041-531158, 546336, 546339, 546340, 546343, 546345, 547474-547483, 547778, 548077-548082, and 548677-548678.

In certain embodiments, nucleobases 33085-33247 of SEQ ID NO: 10 are targeted by the following SEQ ID NOs: 144-160, 261, 693-707, 1256, 1320-1325, 2214, and 2215.

In certain embodiments, antisense oligonucleotides targeting nucleobases 33085-33247 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

6. Nucleobases 30475-30639 of SEQ ID NO: 10

In certain embodiments, antisense oligonucleotides are designed to target nucleobases 30475-30639 of SEQ ID NO: 10 (GENBANK Accession No. NT_016354.19 truncated from nucleobases 111693001 to 11730000). In certain embodiments, nucleobases 30475-30639 of SEQ ID NO: 10 are a hotspot region. In certain embodiments, nucleobases 30475-30639 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 30475-30639 of SEQ ID NO: 10 are targeted by the following ISIS numbers: 531021-531029, 531146, 546297, 546299-546304, 546306-546311, 546313, 546316-546319, 547444-547462, 548031, 548032, and 548034-548056.

In certain embodiments, nucleobases 30475-30639 of SEQ ID NO: 10 are targeted by the following SEQ ID NOs: 124-132, 249, 633-669, and 1650-1674.

In certain embodiments, antisense oligonucleotides targeting nucleobases 30475-30639 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

7. Nucleobases 27362-27524 of SEQ ID NO: 10

In certain embodiments, antisense oligonucleotides are designed to target nucleobases 27362-27524 of SEQ ID NO: 10 (GENBANK Accession No. NT_016354.19 truncated from nucleobases 111693001 to 11730000). In certain embodiments, nucleobases 27362-27524 correspond to exon 9 of PKK (GENBANK Accession No. NT_016354.19 truncated from nucleobases 111693001 to 11730000). In certain embodiments, nucleobases 27362-27524 of SEQ ID NO: 10 are a hotspot region. In certain embodiments, nucleobases 27362-27524 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 27361-27524 of SEQ ID NO: 10 are targeted by the following ISIS numbers: 530985-530999, 546244, 546247-546256, 546258-546260, 546263, 546265-546268, 547403-547417, 547723, 547968-547970, and 547972-547992.

In certain embodiments, nucleobases 27361-27524 of SEQ ID NO: 10 are targeted by the following SEQ ID NOs: 86-100, 554-587, 1217, and 1588-1611.

In certain embodiments, antisense oligonucleotides targeting nucleobases 27362-27524 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

8. Nucleobases 33101-33240 of SEQ ID NO: 10

In certain embodiments, antisense oligonucleotides are designed to target nucleobases 33101-33240 of SEQ ID NO: 10 (GENBANK Accession No. NT_016354.19 truncated from nucleobases 111693001 to 11730000). In certain embodiments, nucleobases 33101-33240 correspond to exon 14 of PKK (GENBANK Accession No. NT_016354.19 truncated from nucleobases 111693001 to 11730000). In certain embodiments, nucleobases 33101-33240 of SEQ ID NO: 10 are a hotspot region. In certain embodiments, nucleobases 33101-33240 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 33101-33240 of SEQ ID NO: 10 are targeted by the following ISIS numbers: 531041-531158, 546336, 546339, 546340, 546343, 546345, 547474-547483, 548077-548082, and 548678-548678.

In certain embodiments, nucleobases 33101-33240 of SEQ ID NO: 10 are targeted by the following SEQ ID NOs: 144-160, 261, 693-707, 1320-1325, and 2215.

In certain embodiments, antisense oligonucleotides targeting nucleobases 33101-33240 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

9. Nucleobases 30463-30638 of SEQ ID NO: 10

In certain embodiments, antisense oligonucleotides are designed to target nucleobases 30463-30638 of SEQ ID NO: 10 (GENBANK Accession No. NT_016354.19 truncated from nucleobases 111693001 to 11730000). In certain embodiments, nucleobases 30463-30638 correspond to exon 12 of PKK (GENBANK Accession No. NT_016354.19 truncated from nucleobases 111693001 to 11730000). In certain embodiments, nucleobases 30463-30638 of SEQ ID NO: 10 are a hotspot region. In certain embodiments, nucleobases 30463-30638 of SEQ ID NO: 10 are targeted by antisense oligonucleotides. In certain embodiments, the antisense oligonucleotides are 15, 16, 17, 18, 19, or 20 nucleobases in length. In certain embodiments, the antisense oligonucleotides are gapmers. In certain embodiments, the gapmers are 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. In certain embodiments, the gapmers are 5-10-5 MOE and cEt gapmers, 4-9-4 MOE and cEt gapmers, 4-10-4 MOE and cEt gapmers, 4-10-3 MOE and cEt gapmers, 3-10-4 MOE and cEt gapmers, or 3-10-3 MOE and cEt gapmers. In certain embodiments, the nucleosides of the antisense oligonucleotides are linked by phosphorothioate internucleoside linkages.

In certain embodiments, nucleobases 30463-30638 of SEQ ID NO: 10 are targeted by the following ISIS numbers: 531021-531029, 531146, 546297, 546299-546304, 546306-546311, 546313, 546316-546319, 547444-547462, 548031, 548032, and 548034-548056.

In certain embodiments, nucleobases 30463-30638 of SEQ ID NO: 10 are targeted by the following SEQ ID NOs: 124-132, 249, 633-669, and 1650-1674.

In certain embodiments, antisense oligonucleotides targeting nucleobases 30463-30638 of SEQ ID NO: 10 achieve at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% reduction of PKK and/or protein levels in vitro and/or in vivo.

EXAMPLES

Non-limiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1

General Method for the Preparation of Phosphoramidites, Compounds 1, 1a and 2

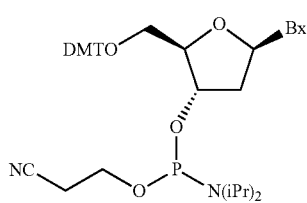

1

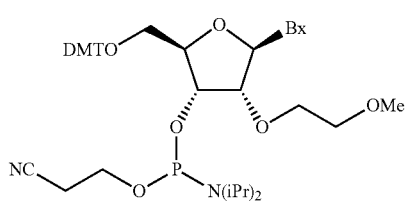

1a

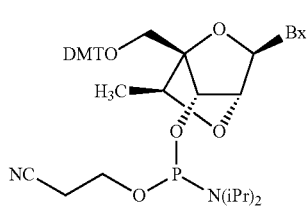

2

Bx is a heterocyclic base;

Compounds 1, 1a and 2 were prepared as per the procedures well known in the art as described in the specification herein (see Seth et al., Bioorg. Med. Chem., 2011, 21(4), 1122-1125, J. Org. Chem., 2010, 75(5), 1569-1581, Nucleic Acids Symposium Series, 2008, 52(1), 553-554); and also see published PCT International Applications (WO 2011/115818, WO 2010/077578, WO2010/036698, WO2009/143369, WO 2009/006478, and WO 2007/090071), and U.S. Pat. No. 7,569,686).

Example 2

Preparation of Compound 7

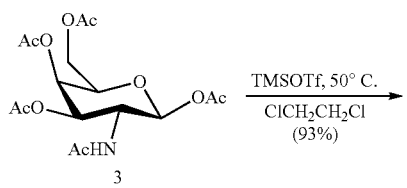

3

169
-continued
170
Example 3
Preparation of Compound 11
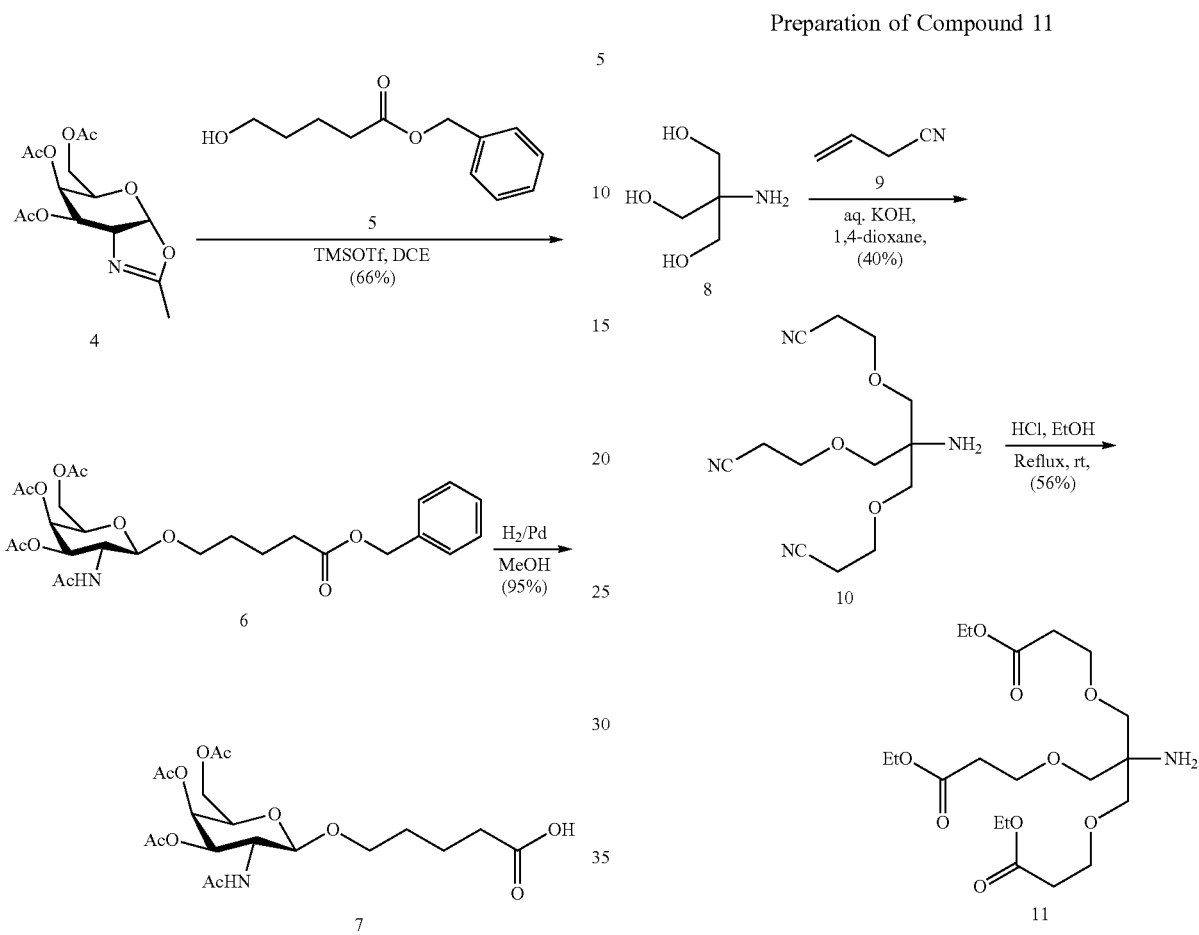
Compounds 8 and 9 are commercially available.
Compounds 3 (2-acetamido-1,3,4,6-tetra-O-acetyl-2-deoxy-β-D galactopyranose or galactosamine pentaacetate) is commercially available. Compound 5 was prepared according to published procedures (Weber et al., *J. Med. Chem.*, 1991, 34, 2692).
Example 4
Preparation of Compound 18
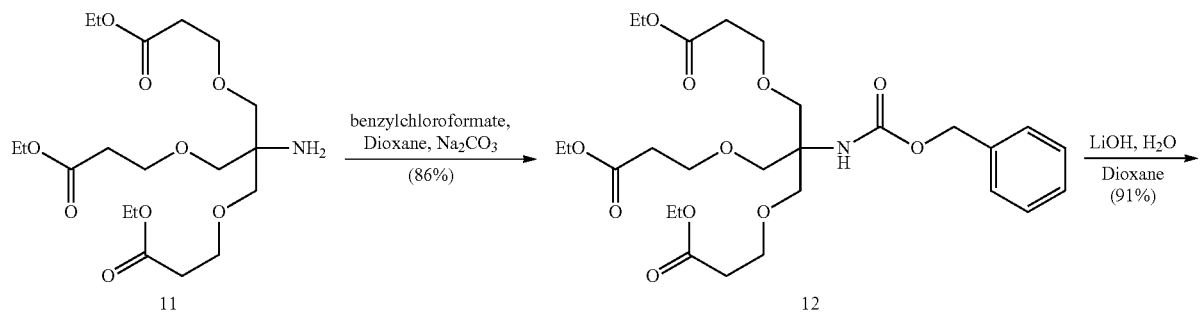

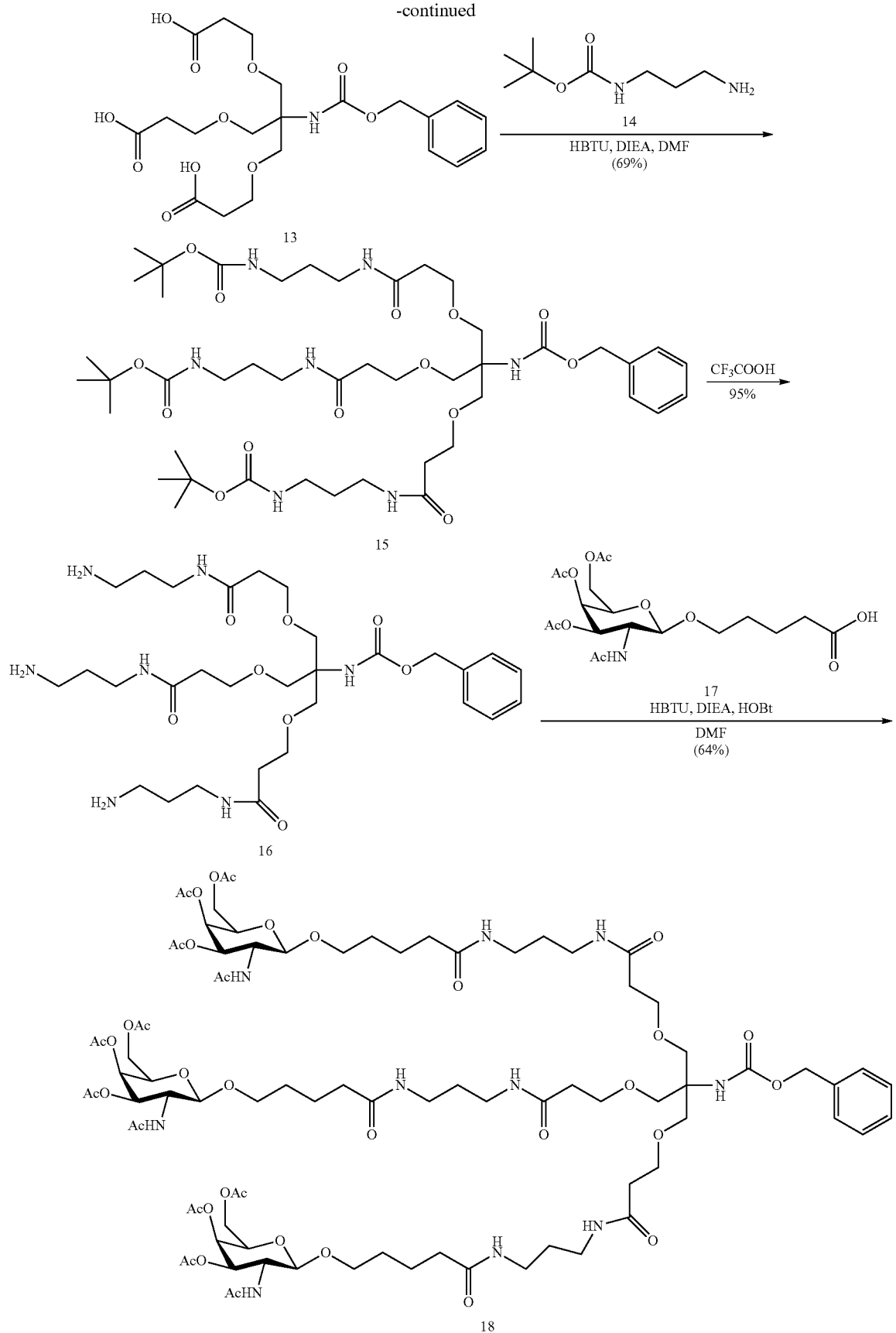

3Compound 11 was prepared as per the procedures illustrated in Example 3. Compound 14 is commercially available. Compound 17 was prepared using similar procedures reported by Rensen et al., *J. Med. Chem.*, 2004, 47, 5798-5808.
Example 5
Preparation of Compound 23
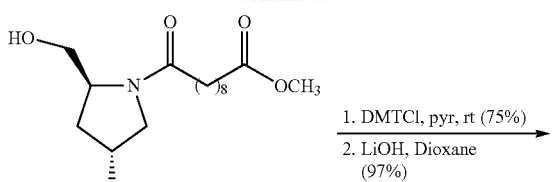
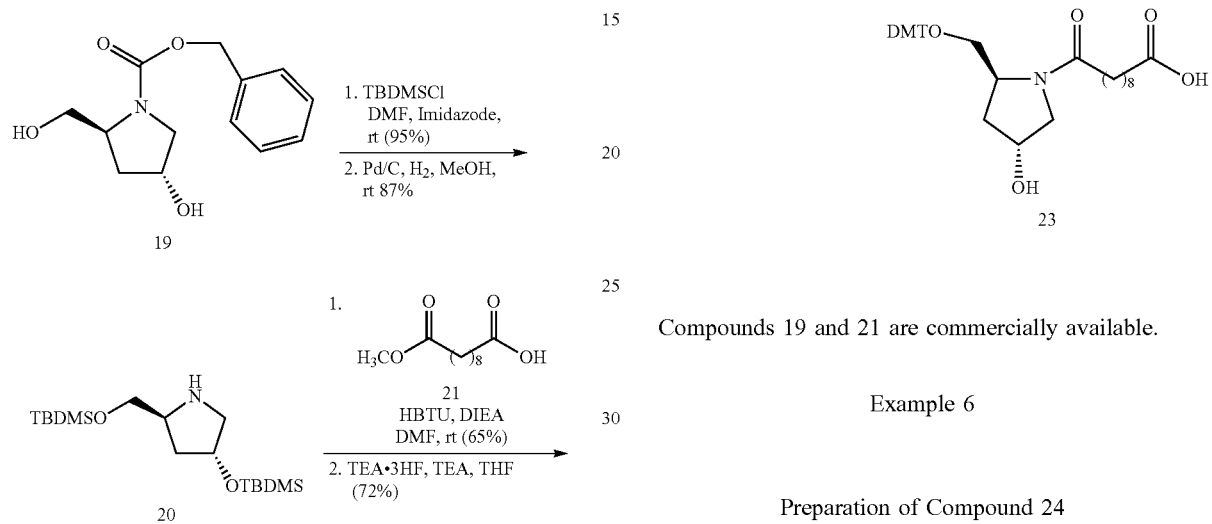
Compounds 19 and 21 are commercially available.
Example 6
Preparation of Compound 24
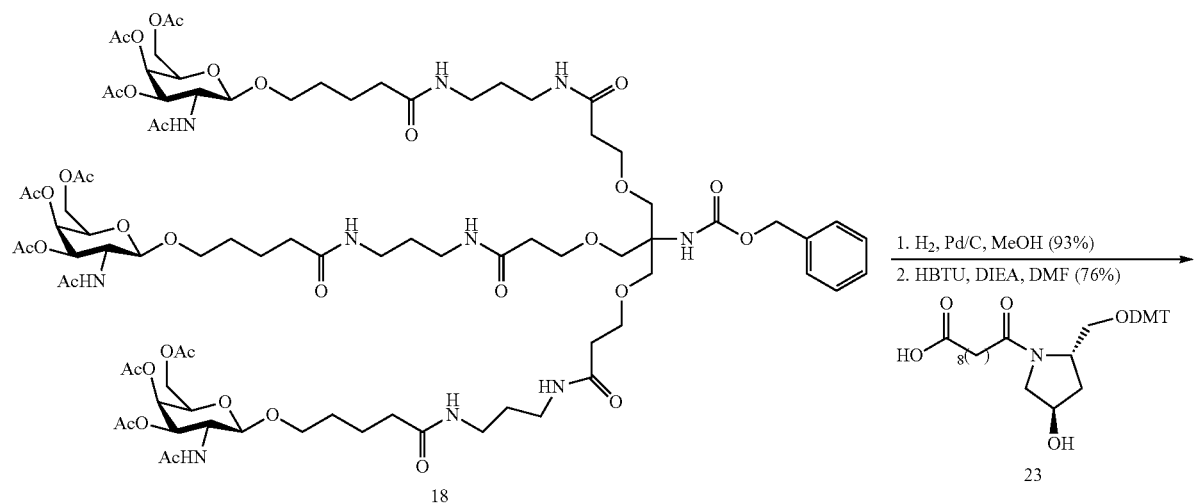

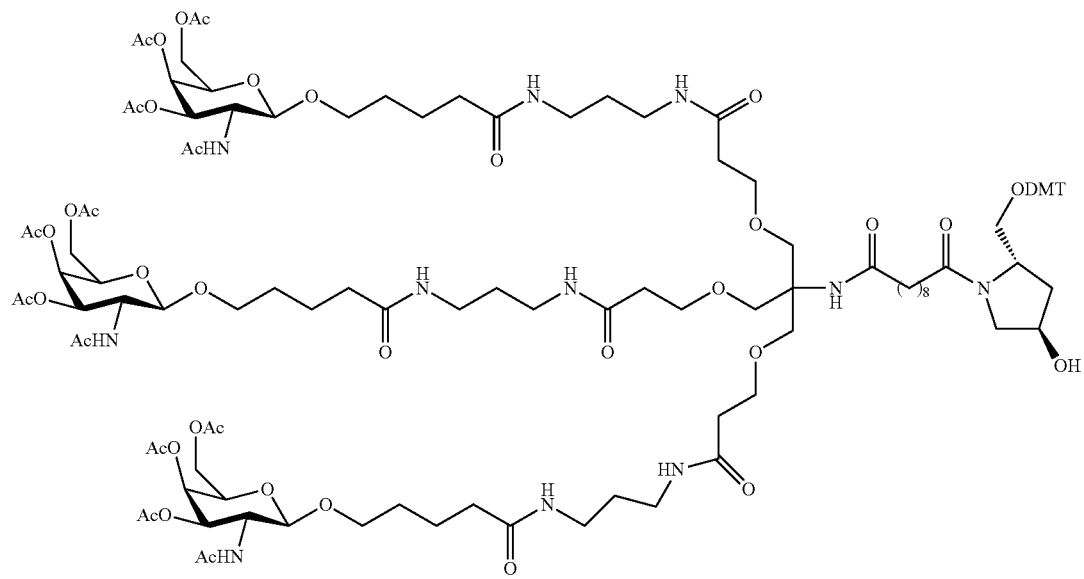
24
Compounds 18 and 23 were prepared as per the procedures illustrated in Examples 4 and 5.
Example 7
Preparation of Compound 25
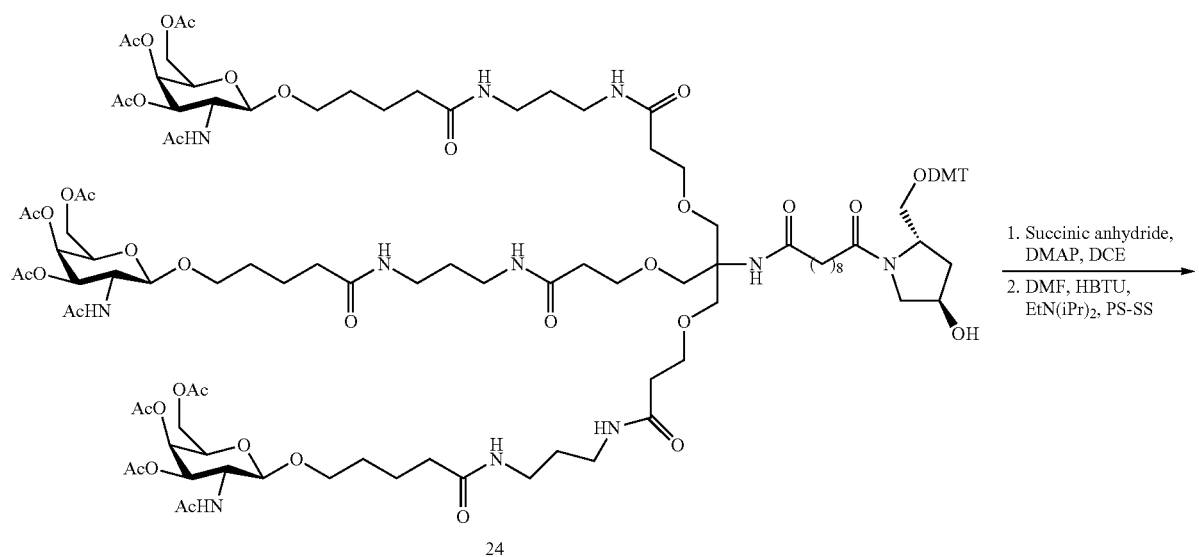
24

-continued
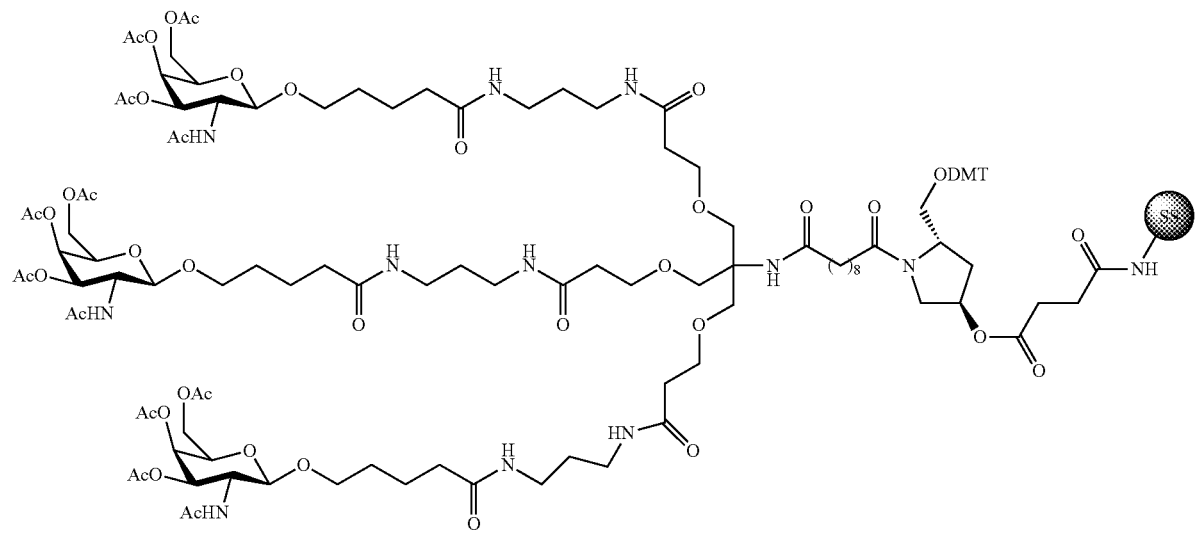
25
Compound 24 was prepared as per the procedures illustrated in Example 6.
Example 8
Preparation of Compound 26
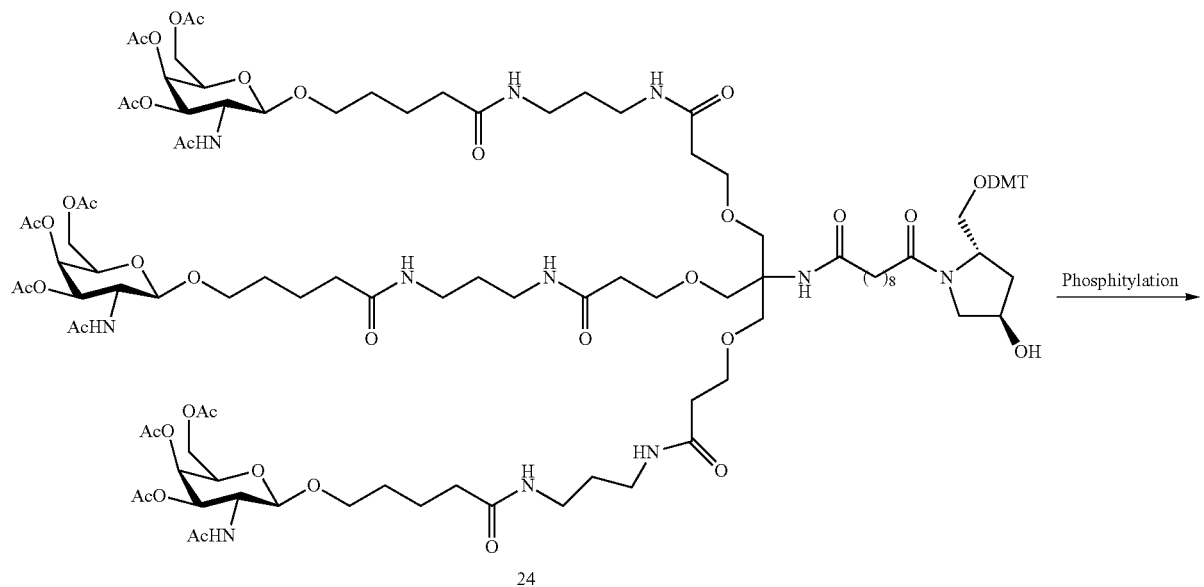
24

-continued
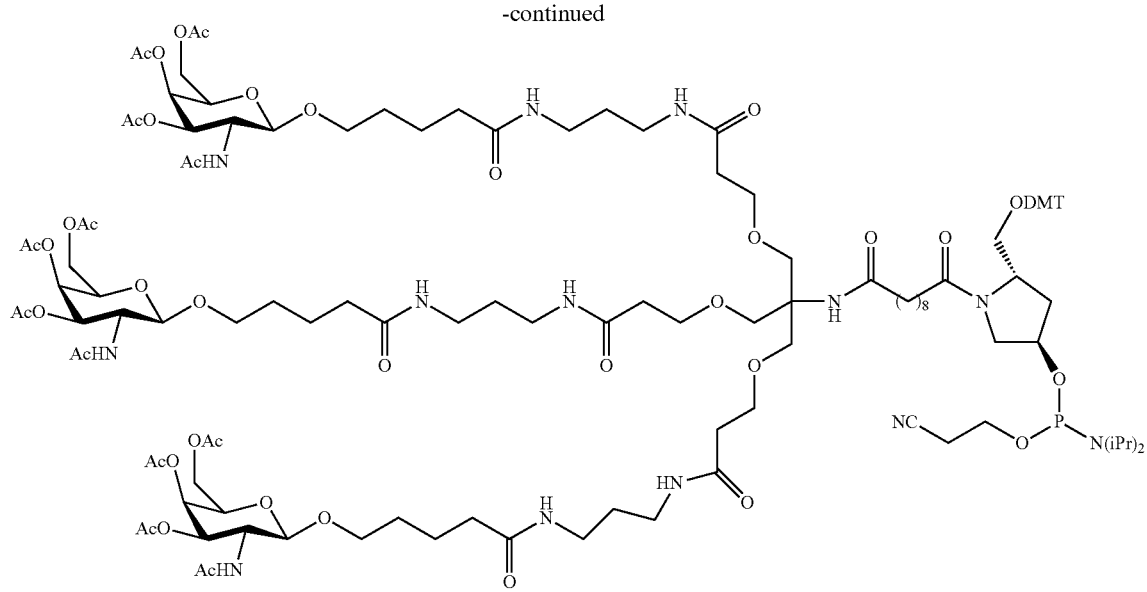
26
Compound 24 is prepared as per the procedures illustrated in Example 6.
Example 9
General Preparation of Conjugated ASOs Comprising GalNAc$_3$-1 at the 3' Terminus, Compound 29
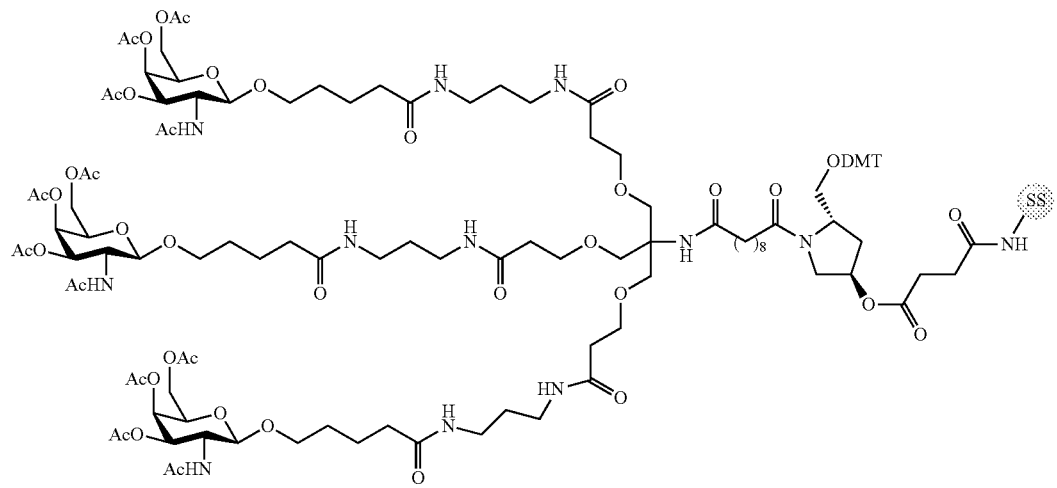
25
1. DCA, DCM
2. DCI, NMI, ACN
   Phosphoramidite
   building block 1
3. Capping
4. t-BuOOH
DNA/RNA automated synthesizer

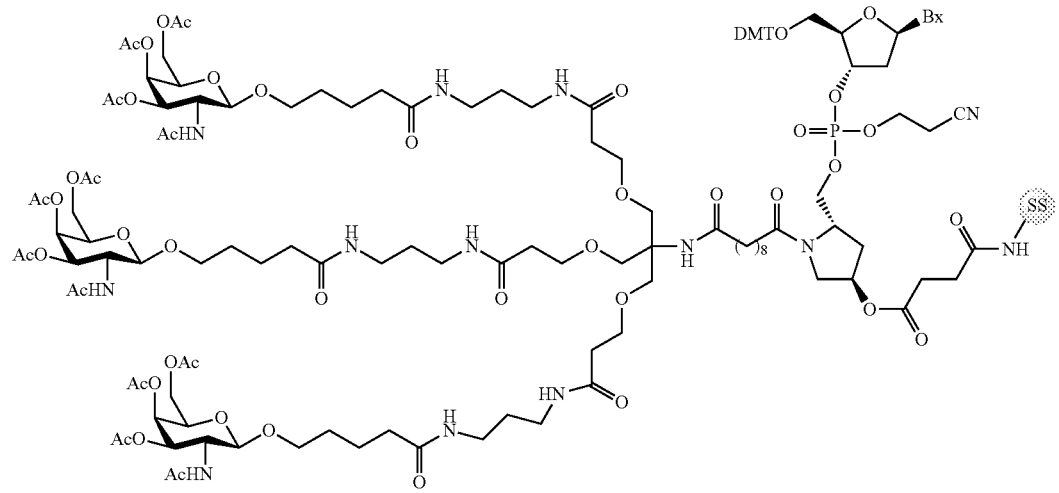
27
1. DCA, DCM
2. DCI, NMI, ACN
   Phosphoramidite
   building block 1a
3. Capping
4. t-BuOOH
DNA/RNA automated synthesizer
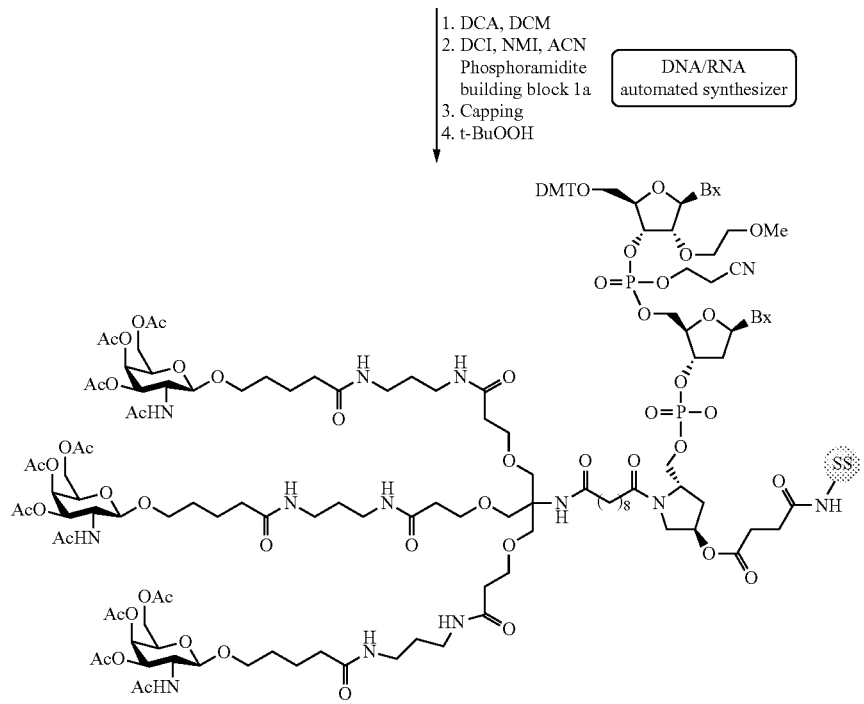
28
1. DCA, DCM
2. DCI, NMI, ACN
   Phosphoramidite building blocks
3. Capping
4. xanthane hydride or t-BuOOH
5. Et$_3$N/CH$_3$CN (1:1)
6. Aqueous NH$_3$ (cleavage)
DNA/RNA automated synthesizer

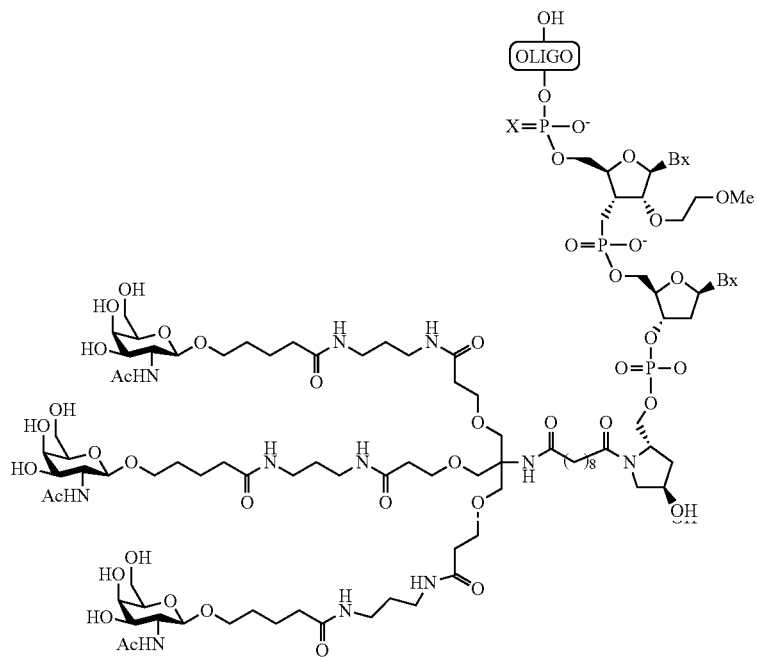
29
Bx = Heterocyclic base
X = O or S
Wherein the protected GalNAc$_3$-1 has the structure:
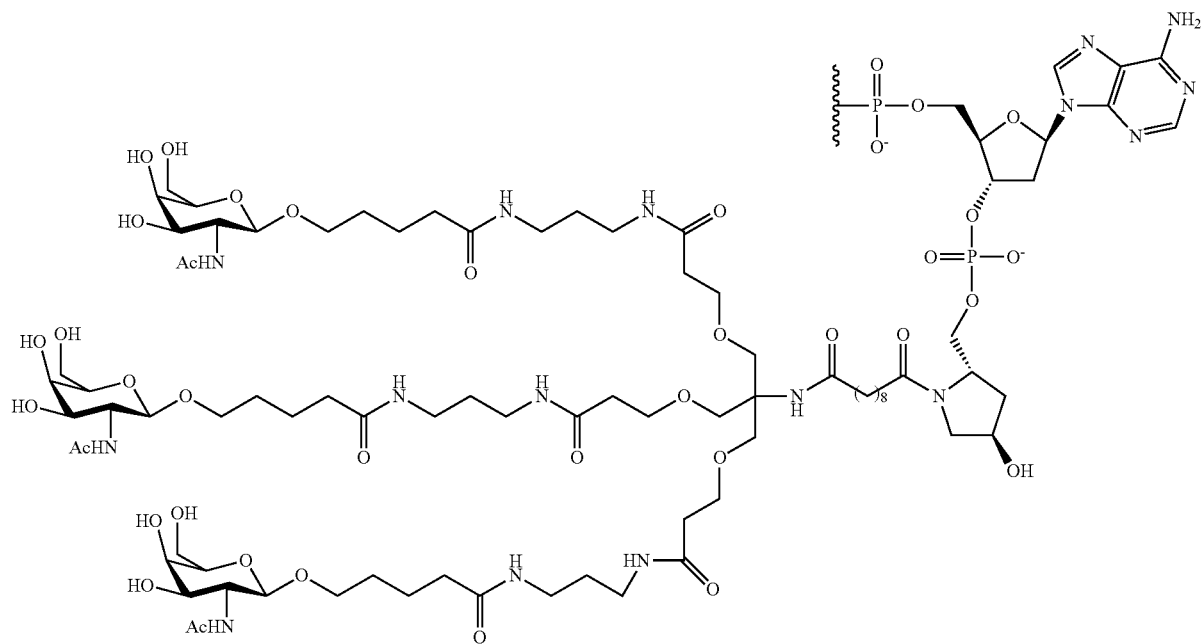
65
The GalNAc$_3$ cluster portion of the conjugate group GalNAc$_3$-1 (GalNAc$_3$-1$_a$) can be combined with any cleavable moiety to provide a variety of conjugate groups. Wherein GalNAc$_3$-1$_a$ has the formula:

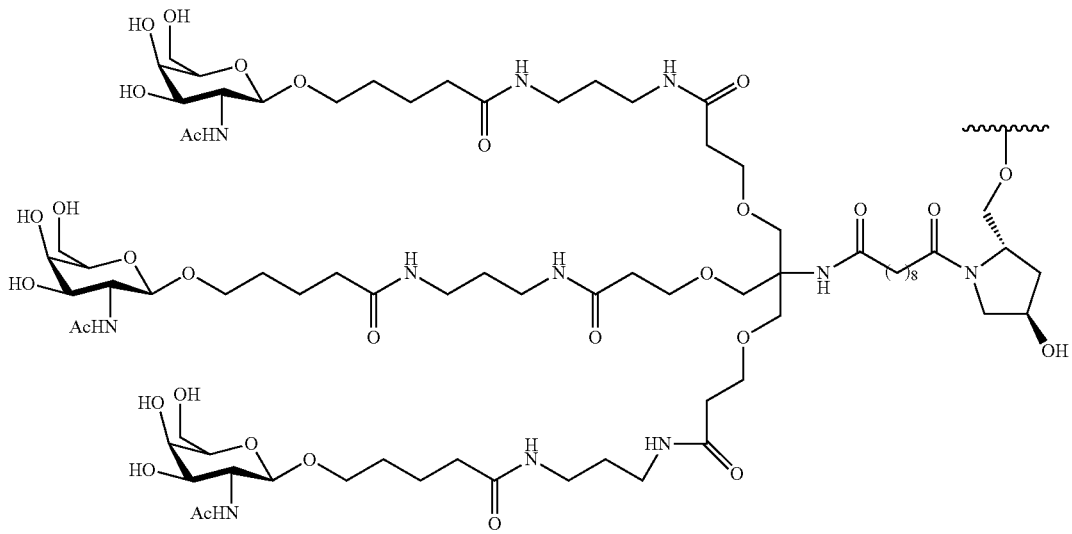

The solid support bound protected GalNAc₃-1, Compound 25, was prepared as per the procedures illustrated in Example 7. Oligomeric Compound 29 comprising GalNAc₃-1 at the 3' terminus was prepared using standard procedures in automated DNA/RNA synthesis (see Dupouy et al., *Angew. Chem. Int. Ed.*, 2006, 45, 3623-3627). Phosphoramidite building blocks, Compounds 1 and 1a were prepared as per the procedures illustrated in Example 1. The phosphoramidites illustrated are meant to be representative and not intended to be limiting as other phosphoramidite building blocks can be used to prepare oligomeric compounds having a predetermined sequence and composition.

The order and quantity of phosphoramidites added to the solid support can be adjusted to prepare gapped oligomeric compounds as described herein. Such gapped oligomeric compounds can have predetermined composition and base sequence as dictated by any given target.

Example 10

General Preparation Conjugated ASOs Comprising GalNAc₃-1 at the 5' Terminus, Compound 34

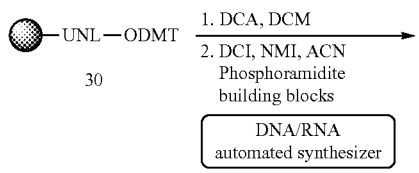

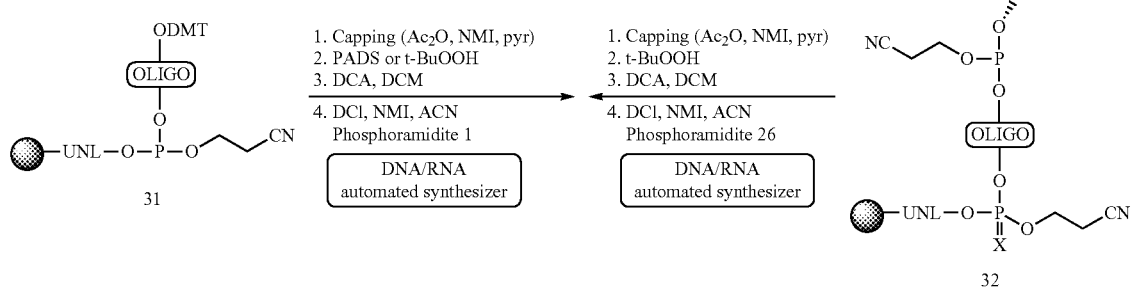

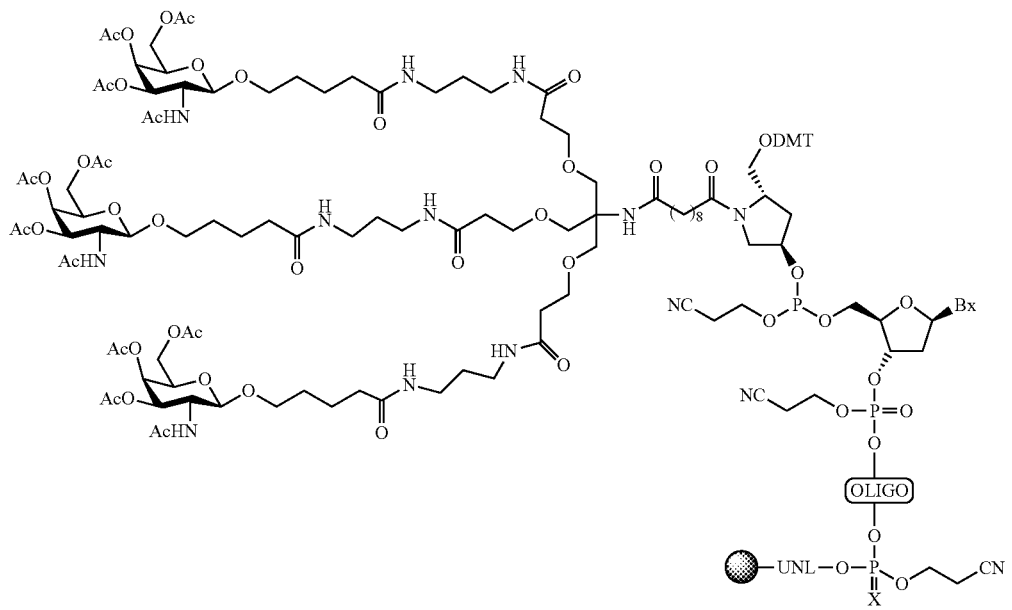
33
1. Capping (Ac₂O, NMI, pyr)
2. t-BuOOH
3. Et₃N:CH₃CN (1:1 v/v)
4. DCA, DCM
5. NH₄, rt (cleavage)
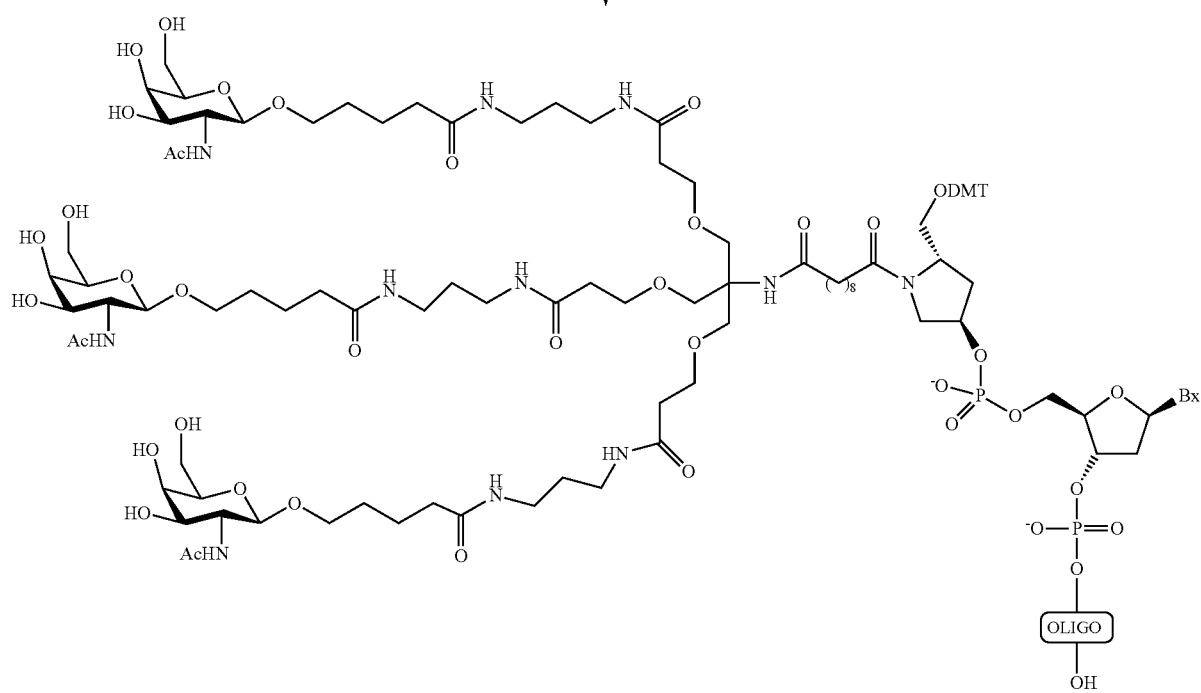
34
X = O, or S
Bx = Heterocylic base The Unylinker™ 30 is commercially available. Oligomeric Compound 34 comprising a GalNAc$_3$-1 cluster at the 5' terminus is prepared using standard procedures in automated DNA/RNA synthesis (see Dupouy et al., *Angew. Chem. Int. Ed.*, 2006, 45, 3623-3627). Phosphoramidite building blocks, Compounds 1 and 1a were prepared as per the procedures illustrated in Example 1. The phosphoramidites illustrated are meant to be representative and not intended to be limiting as other phosphoramidite building blocks can be used to prepare an oligomeric compound having a predetermined sequence and composition. The order and quantity of phosphoramidites added to the solid support can be adjusted to prepare gapped oligomeric compounds as described herein. Such gapped oligomeric compounds can have predetermined composition and base sequence as dictated by any given target.

Example 11

Preparation of Compound 39

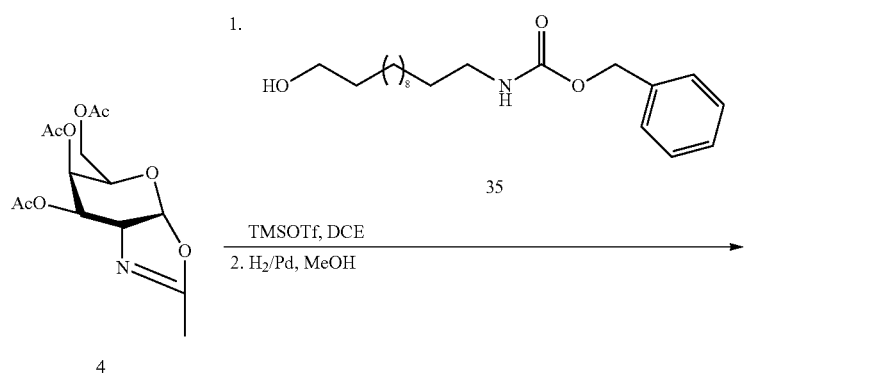

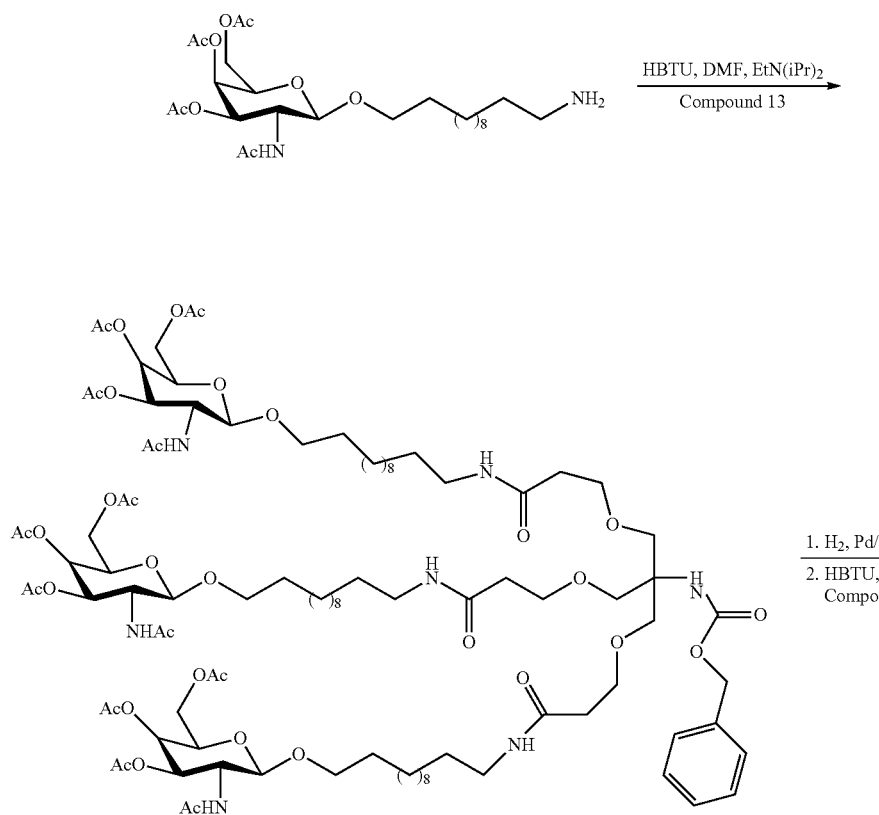

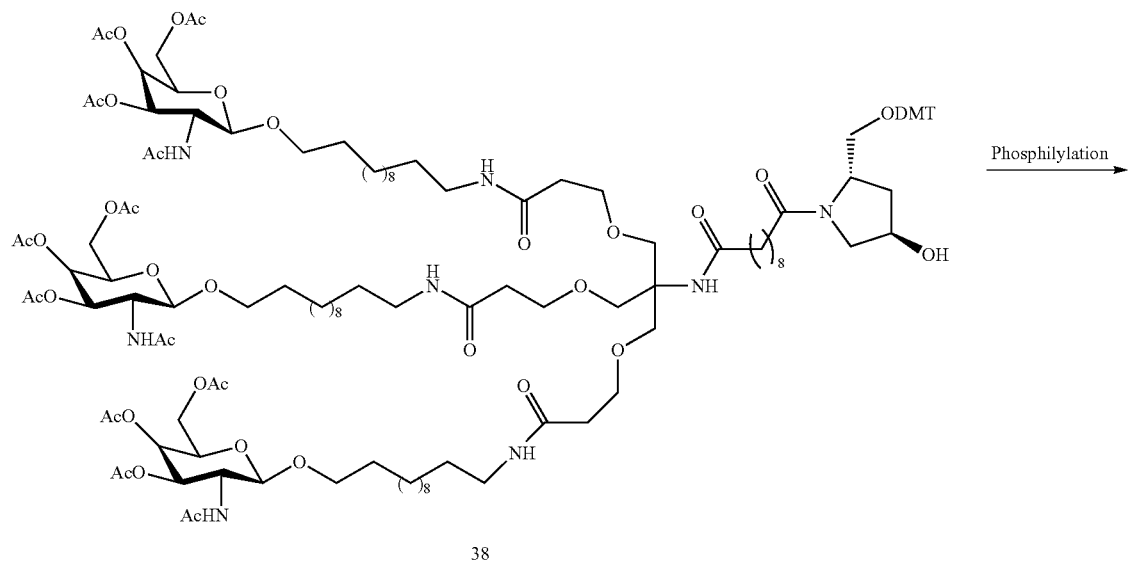
38
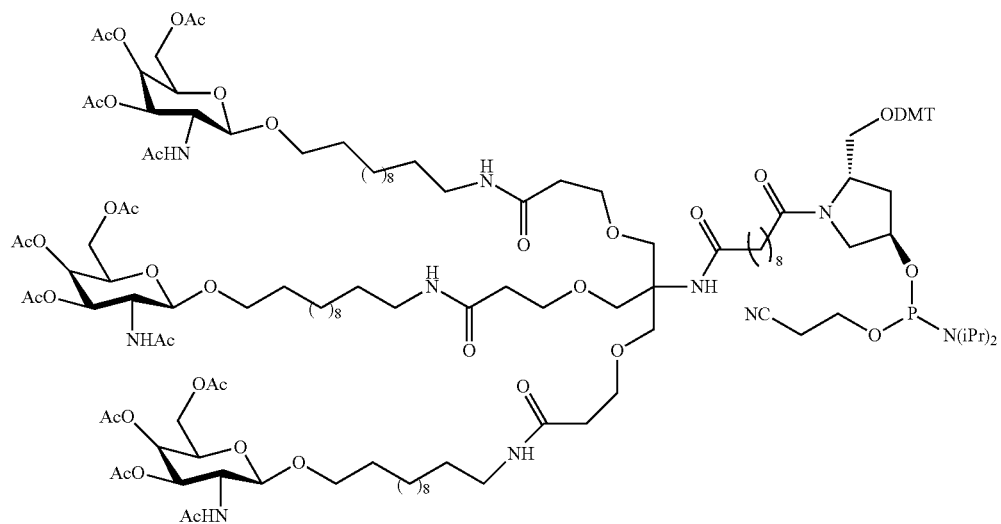
39
Compounds 4, 13 and 23 were prepared as per the procedures illustrated in Examples 2, 4, and 5. Compound 35 is prepared using similar procedures published in Rouchaud et al., *Eur. J. Org. Chem.*, 2011, 12, 2346-2353.

Example 12
Preparation of Compound 40
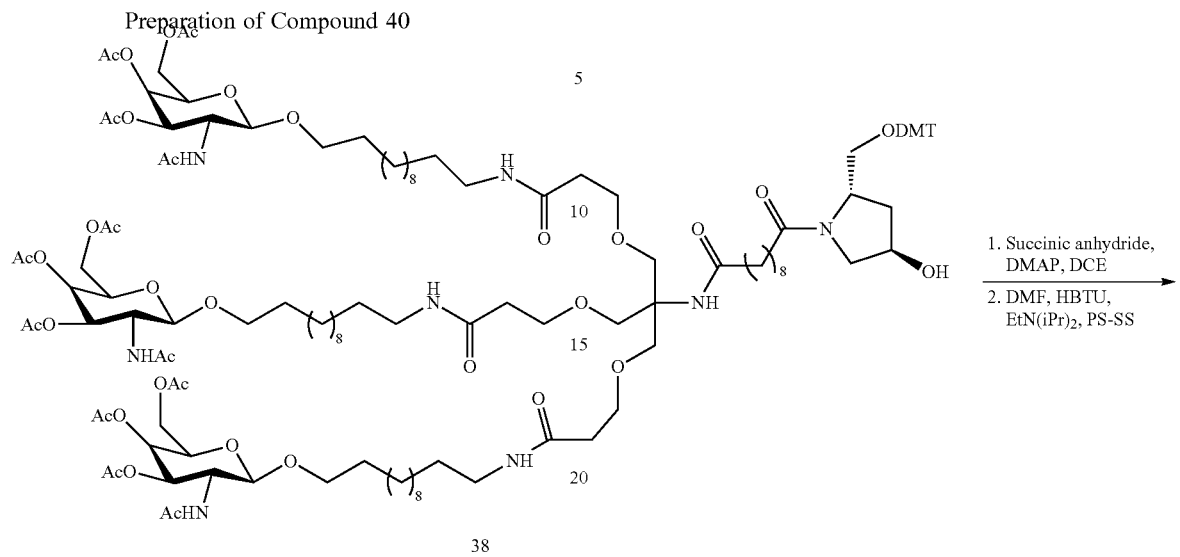
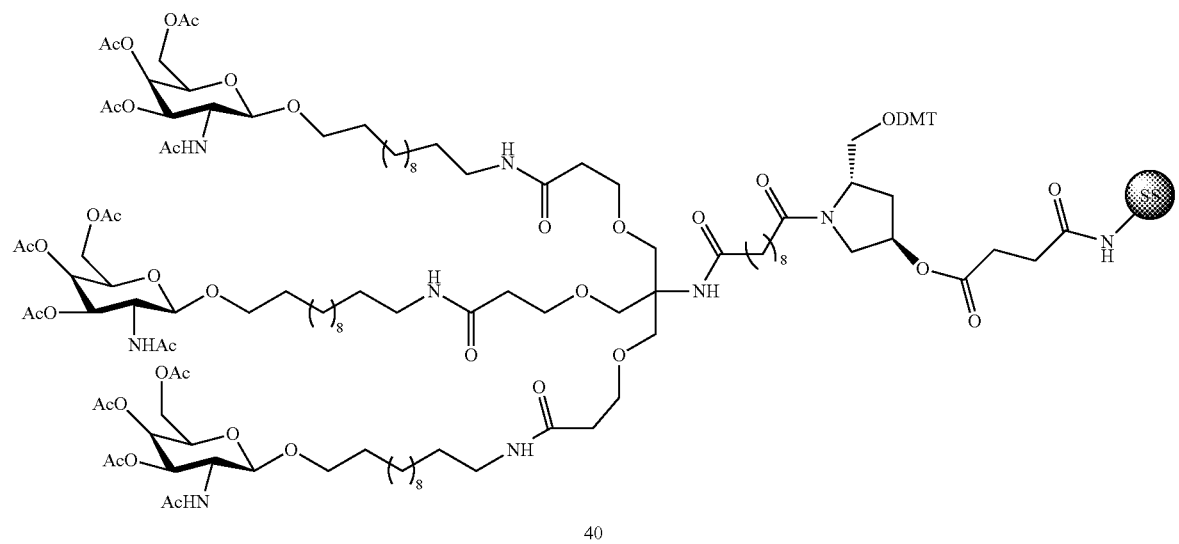
Compound 38 is prepared as per the procedures illustrated in Example 11.
Example 13
Preparation of Compound 44

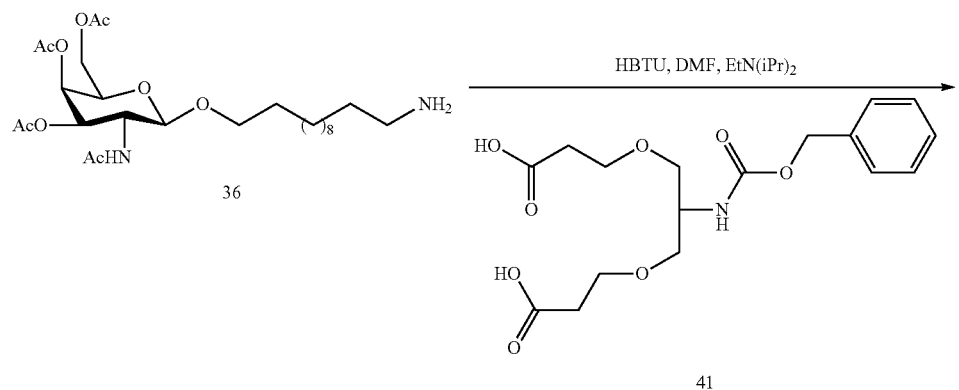
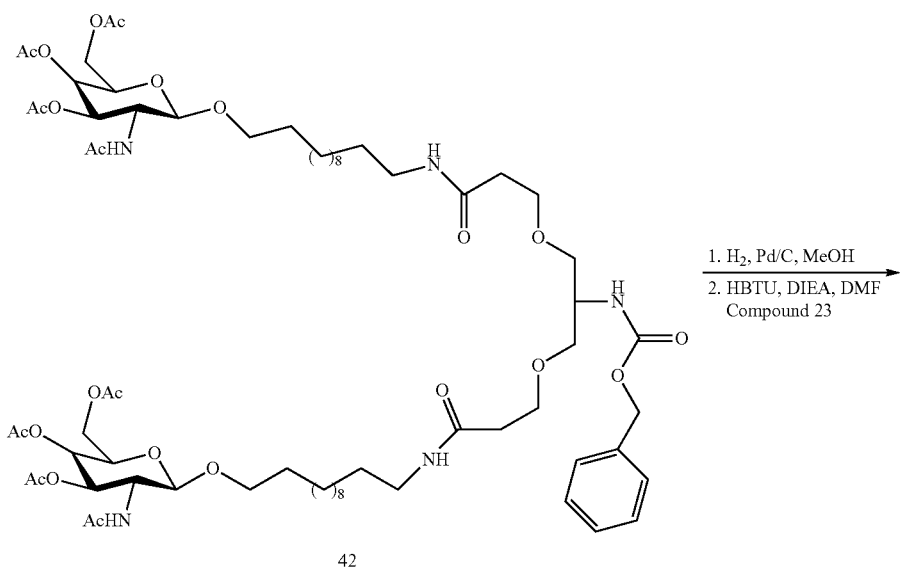
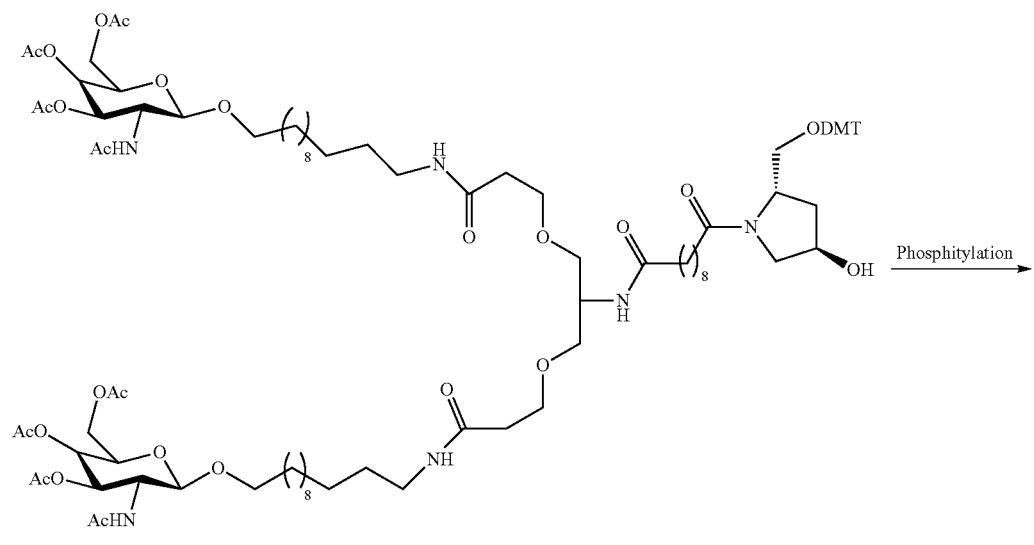

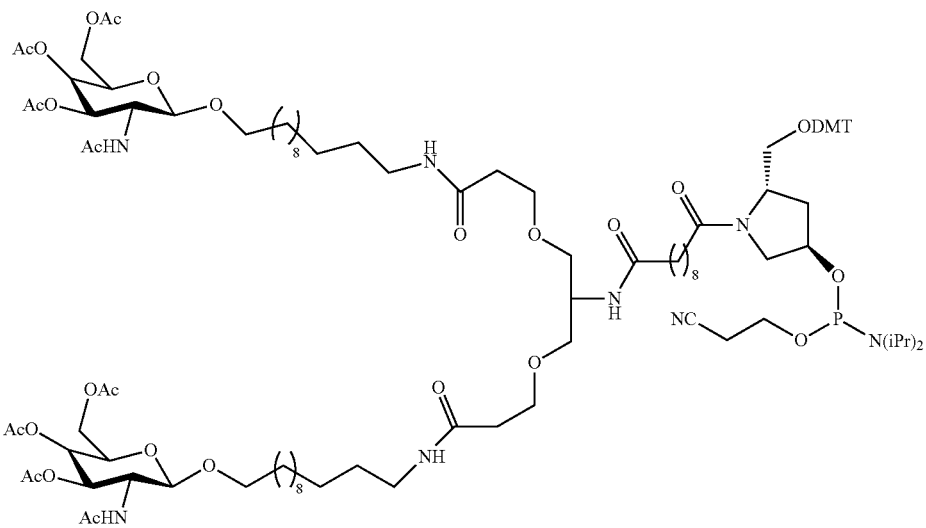
44
Compounds 23 and 36 are prepared as per the procedures illustrated in Examples 5 and 11. Compound 41 is prepared using similar procedures published in WO 2009082607.
Example 14
Preparation of Compound 45
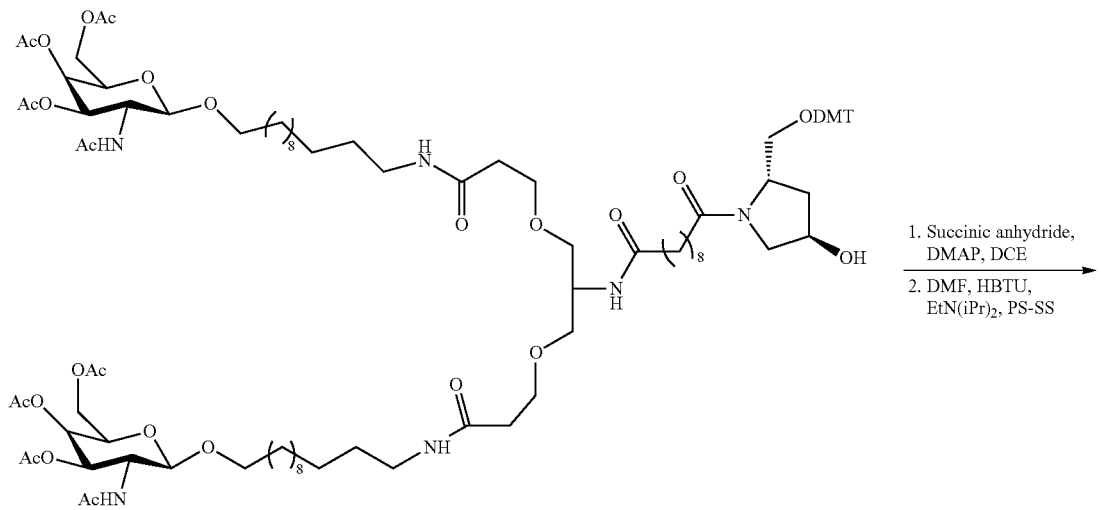
43
1. Succinic anhydride, DMAP, DCE
2. DMF, HBTU, EtN(iPr)$_2$, PS-SS

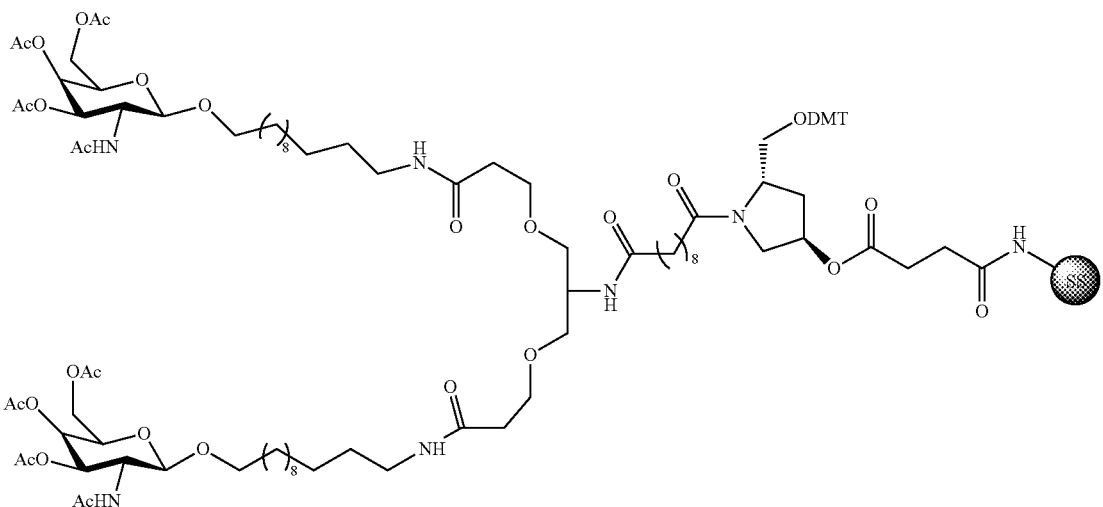
45
Compound 43 is prepared as per the procedures illustrated in Example 13.
Example 15
Preparation of Compound 47
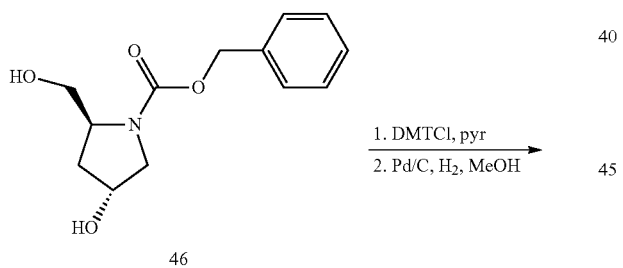
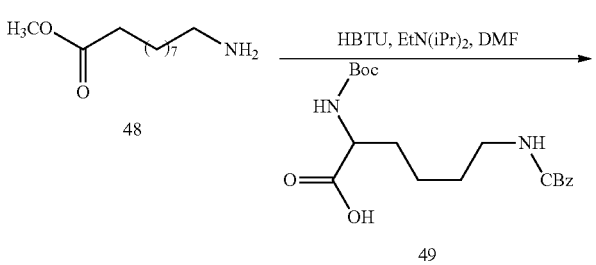
Compound 46 is commercially available.
Example 16
Preparation of Compound 53

-continued
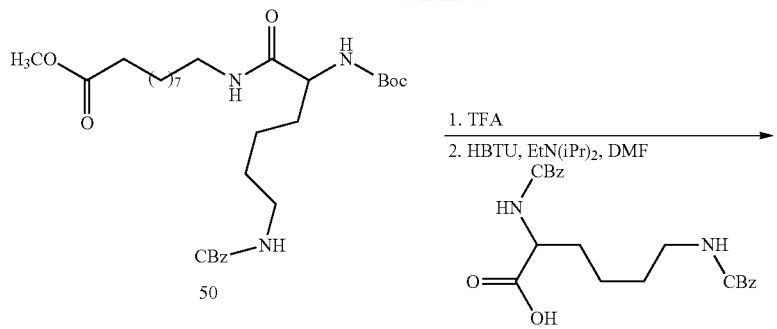
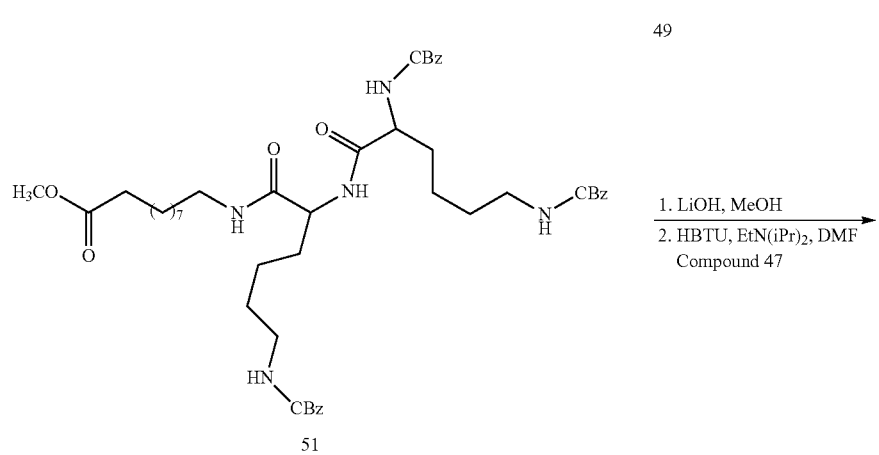
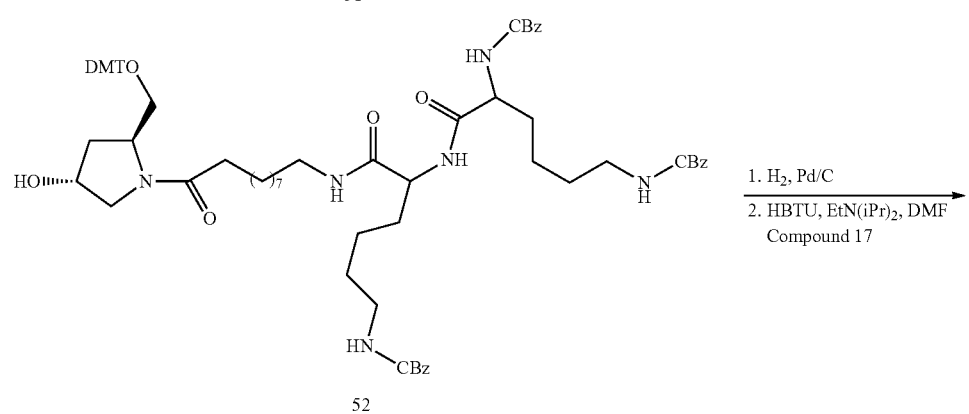
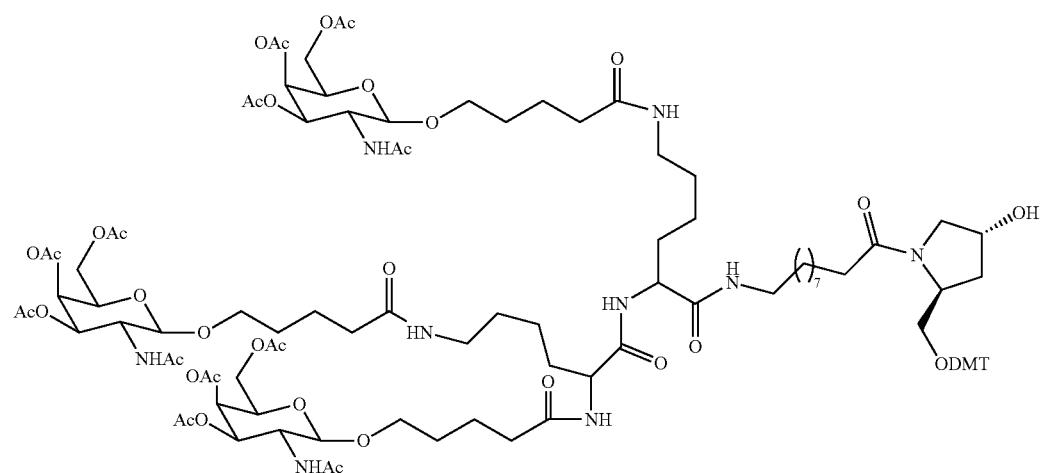

Compounds 48 and 49 are commercially available. Compounds 17 and 47 are prepared as per the procedures illustrated in Examples 4 and 15.
Example 17
Preparation of Compound 54
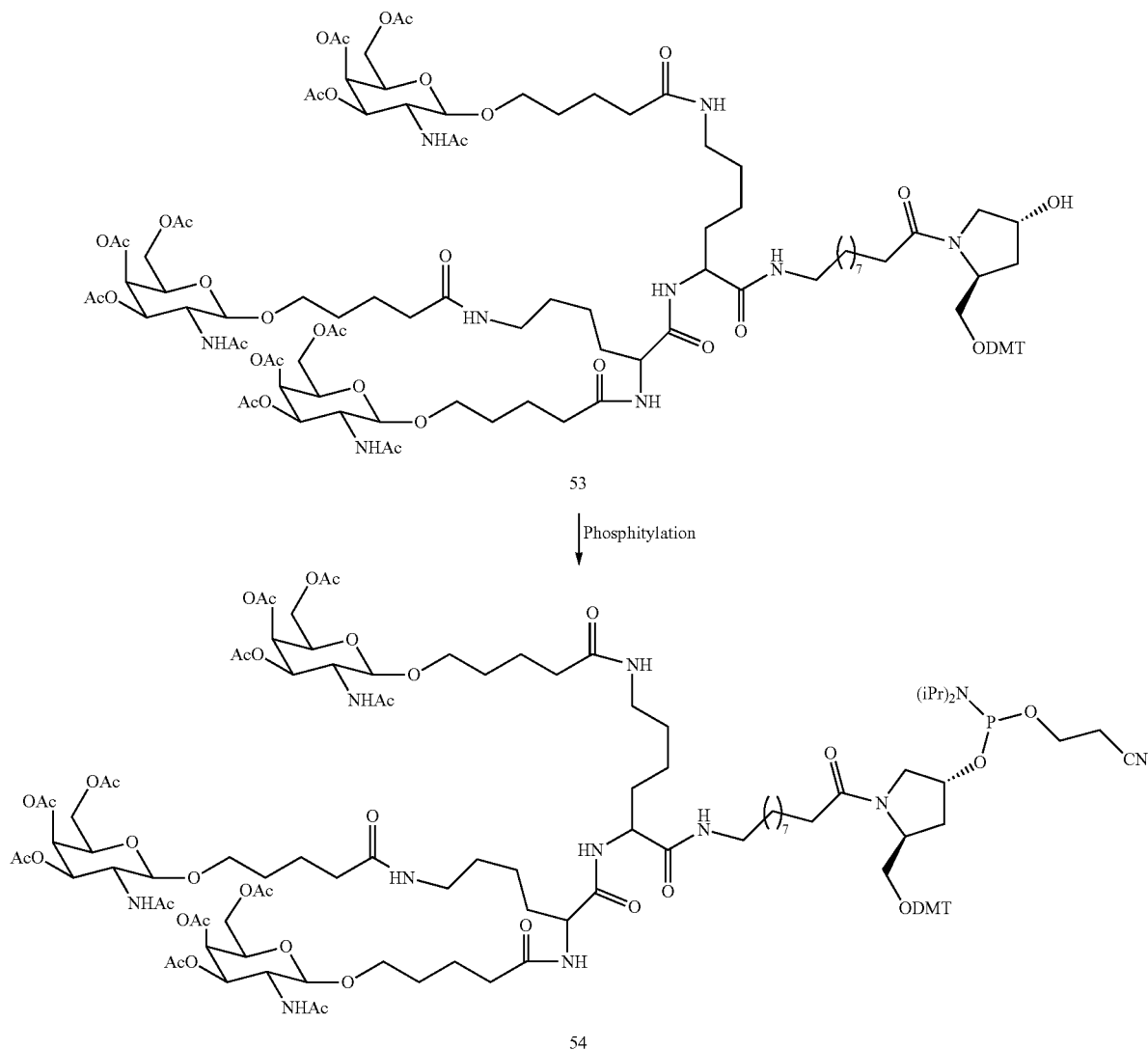
Compound 53 is prepared as per the procedures illustrated in Example 16.
Example 18
Preparation of Compound 55

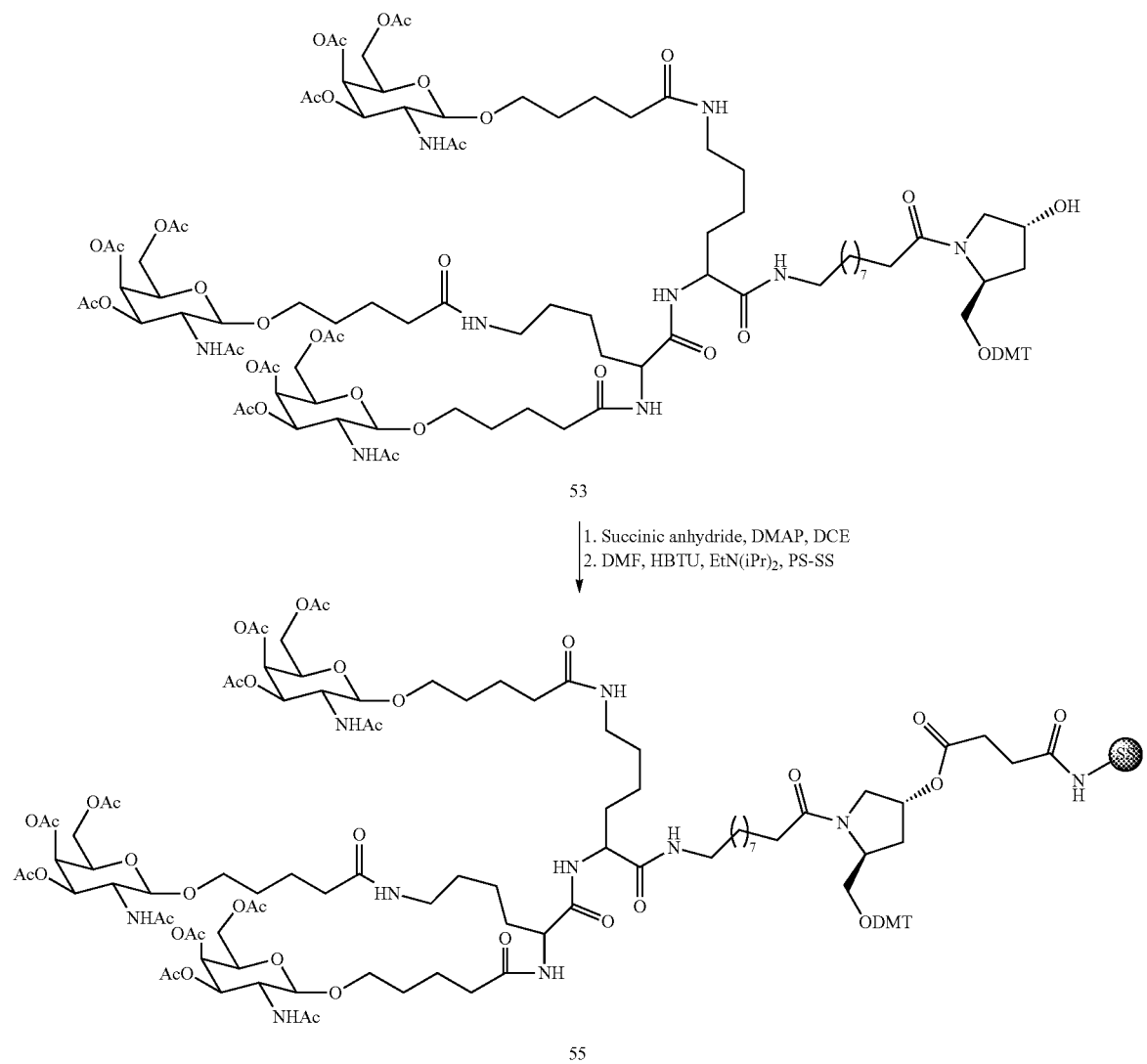

Compound 53 is prepared as per the procedures illustrated in Example 16.

Example 19

General Method for the Preparation of Conjugated ASOs Comprising GalNAc$_3$-1 at the 3' Position Via Solid Phase Techniques (Preparation of ISIS 647535, 647536 and 651900)

Unless otherwise stated, all reagents and solutions used for the synthesis of oligomeric compounds are purchased from commercial sources. Standard phosphoramidite building blocks and solid support are used for incorporation nucleoside residues which include for example T, A, G, and $^m$C residues. A 0.1 M solution of phosphoramidite in anhydrous acetonitrile was used for β-D-2'-deoxyribonucleoside and 2'-MOE.

The ASO syntheses were performed on ABI 394 synthesizer (1-2 μmol scale) or on GE Healthcare Bioscience ÄKTA oligopilot synthesizer (40-200 μmol scale) by the phosphoramidite coupling method on an GalNAc$_3$-1 loaded VIMAD solid support (110 μmol/g, Guzaev et al., 2003) packed in the column. For the coupling step, the phosphoramidites were delivered 4 fold excess over the loading on the solid support and phosphoramidite condensation was carried out for 10 min. All other steps followed standard protocols supplied by the manufacturer. A solution of 6% dichloroacetic acid in toluene was used for removing dimethoxytrityl (DMT) group from 5'-hydroxyl group of the nucleotide. 4,5-Dicyanoimidazole (0.7 M) in anhydrous CH$_3$CN was used as activator during coupling step. Phosphorothioate linkages were introduced by sulfurization with 0.1 M solution of xanthane hydride in 1:1 pyridine/CH$_3$CN for a contact time of 3 minutes. A solution of 20% tert-butylhydroperoxide in CH$_3$CN containing 6% water was used as an oxidizing agent to provide phosphodiester internucleoside linkages with a contact time of 12 minutes.

After the desired sequence was assembled, the cyanoethyl phosphate protecting groups were deprotected using a 1:1

(v/v) mixture of triethylamine and acetonitrile with a contact time of 45 minutes. The solid-support bound ASOs were suspended in aqueous ammonia (28-30 wt %) and heated at 55° C. for 6 h.

The unbound ASOs were then filtered and the ammonia was boiled off. The residue was purified by high pressure liquid chromatography on a strong anion exchange column (GE Healthcare Bioscience, Source 30Q, 30 µm, 2.54×8 cm, A=100 mM ammonium acetate in 30% aqueous $CH_3CN$, B=1.5 M NaBr in A, 0-40% of B in 60 min, flow 14 mL min-1, $\lambda$=260 nm). The residue was desalted by HPLC on a reverse phase column to yield the desired ASOs in an isolated yield of 15-30% based on the initial loading on the solid support. The ASOs were characterized by ion-pair-HPLC coupled MS analysis with Agilent 1100 MSD system.

Antisense oligonucleotides not comprising a conjugate were synthesized using standard oligonucleotide synthesis procedures well known in the art.

Using these methods, three separate antisense compounds targeting ApoC III were prepared. As summarized in Table 17, below, each of the three antisense compounds targeting ApoC III had the same nucleobase sequence; ISIS 304801 is a 5-10-5 MOE gapmer having all phosphorothioate linkages; ISIS 647535 is the same as ISIS 304801, except that it had a $GalNAc_3$-1 conjugated at its 3' end; and ISIS 647536 is the same as ISIS 647535 except that certain internucleoside linkages of that compound are phosphodiester linkages. As further summarized in Table 17, two separate antisense compounds targeting SRB-1 were synthesized. ISIS 440762 was a 2-10-2 cEt gapmer with all phosphorothioate internucleoside linkages; ISIS 651900 is the same as ISIS 440762, except that it included a $GalNAc_3$-1 at its 3'-end.

TABLE 17

Modified ASO targeting ApoC III and SRB-1

| ASO | Sequence (5' to 3') | Target | CalCd Mass | Observed Mass | SEQ ID No. |
|---|---|---|---|---|---|
| ISIS 304801 | $A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_e$ | ApoC III | 7165.4 | 7164.4 | 2248 |
| ISIS 647535 | $A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_{eo}A_{do'}\text{-}GalNAc_3\text{-}1_a$ | ApoC III | 9239.5 | 9237.8 | 2249 |
| ISIS 647536 | $A_{es}G_{eo}{}^mC_{eo}T_{eo}T_{eo}{}^mC_{ds}T_{ds}T_{ds}G_{ds}T_{ds}{}^mC_{ds}{}^mC_{ds}A_{ds}G_{ds}{}^mC_{ds}T_{eo}T_{eo}T_{es}A_{es}T_{eo}A_{do'}\text{-}GalNAc_3\text{-}1_a$ | ApoC III | 9142.9 | 9140.8 | 2249 |
| ISIS 440762 | $T_{ks}{}^mC_{ks}A_{ds}G_{ds}T_{ds}{}^mC_{ds}A_{ds}T_{ds}G_{ds}A_{ds}{}^mC_{ds}T_{ds}T_{ks}{}^mC_k$ | SRB-1 | 4647.0 | 4646.4 | 2250 |
| ISIS 651900 | $T_{ks}{}^mC_{ks}A_{ds}G_{ds}T_{ds}{}^mC_{ds}A_{ds}T_{ds}G_{ds}A_{ds}{}^mC_{ds}T_{ds}T_{ks}{}^mC_{ko}A_{do'}\text{-}GalNAc_3\text{-}1_a$ | SRB-1 | 6721.1 | 6719.4 | 2251 |

Subscripts: "e" indicates 2'-MOE modified nucleoside; "d" indicates β-D-2'-deoxyribonucleoside; "k" indicates 6'-(S)—$CH_3$ bicyclic nucleoside (e.g. cEt); "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. "$GalNAc_3$-1" indicates a conjugate group having the structure shown previously in Example 9. Note that $GalNAc_3$-1 comprises a cleavable adenosine which links the ASO to remainder of the conjugate, which is designated "$GalNAc_3$-$1_a$." This nomenclature is used in the above table to show the full nucleobase sequence, including the adenosine, which is part of the conjugate. Thus, in the above table, the sequences could also be listed as ending with "$GalNAc_3$-1" with the "$A_{do}$" omitted. This convention of using the subscript "a" to indicate the portion of a conjugate group lacking a cleavable nucleoside or cleavable moiety is used throughout these Examples. This portion of a conjugate group lacking the cleavable moiety is referred to herein as a "cluster" or "conjugate cluster" or "$GalNAc_3$ cluster." In certain instances it is convenient to describe a conjugate group by separately providing its cluster and its cleavable moiety.

Example 20

Dose-dependent Antisense Inhibition of Human ApoC III in huApoC III Transgenic Mice ISIS 304801 and ISIS 647535, each targeting human ApoC III and described above, were separately tested and evaluated in a dose-dependent study for their ability to inhibit human ApoC III in human ApoC III transgenic mice.

Treatment

Human ApoCIII transgenic mice were maintained on a 12-hour light/dark cycle and fed ad libitum Teklad lab chow. Animals were acclimated for at least 7 days in the research facility before initiation of the experiment. ASOs were prepared in PBS and sterilized by filtering through a 0.2 micron filter. ASOs were dissolved in 0.9% PBS for injection.

Human ApoC III transgenic mice were injected intraperitoneally once a week for two weeks with ISIS 304801 or 647535 at 0.08, 0.25. 0.75, 2.25 or 6.75 µmol/kg or with PBS as a control. Each treatment group consisted of 4 animals. Forty-eight hours after the administration of the last dose, blood was drawn from each mouse and the mice were sacrificed and tissues were collected.

ApoC III mRNA Analysis

ApoC III mRNA levels in the mice's livers were determined using real-time PCR and RIBOGREEN® RNA quantification reagent (Molecular Probes, Inc. Eugene, Oreg.) according to standard protocols. ApoC III mRNA levels were determined relative to total RNA (using Ribogreen), prior to normalization to PBS-treated control. The results below are presented as the average percent of ApoC III mRNA levels for each treatment group, normalized to PBS-treated control and are denoted as "% PBS". The half maximal effective dosage ($ED_{50}$) of each ASO is also presented in Table 18, below.

As illustrated, both antisense compounds reduced ApoC III RNA relative to the PBS control. Further, the antisense compound conjugated to GalNAc$_3$-1 (ISIS 647535) was substantially more potent than the antisense compound lacking the GalNAc$_3$-1 conjugate (ISIS 304801).

TABLE 18

Effect of ASO treatment on ApoC III mRNA levels in human ApoC III transgenic mice

| ASO | Dose (μmol/kg) | % PBS | $ED_{50}$ (μmol/kg) | 3' Conjugate | Internucleoside linkage/Length | SEQ ID No. |
|---|---|---|---|---|---|---|
| PBS | 0 | 100 | — | — | — | |
| ISIS 304801 | 0.08 | 95 | 0.77 | None | PS/20 | 2248 |
| | 0.75 | 42 | | | | |
| | 2.25 | 32 | | | | |
| | 6.75 | 19 | | | | |
| ISIS 647535 | 0.08 | 50 | 0.074 | GalNAc$_3$-1 | PS/20 | 2249 |
| | 0.75 | 15 | | | | |
| | 2.25 | 17 | | | | |
| | 6.75 | 8 | | | | |

ApoC III Protein Analysis (Turbidometric Assay)

Plasma ApoC III protein analysis was determined using procedures reported by Graham et al, Circulation Research, published online before print Mar. 29, 2013.

Approximately 100 μl of plasma isolated from mice was analyzed without dilution using an Olympus Clinical Analyzer and a commercially available turbidometric ApoC III assay (Kamiya, Cat#KAI-006, Kamiya Biomedical, Seattle, Wash.). The assay protocol was performed as described by the vendor.

As shown in the Table 19 below, both antisense compounds reduced ApoC III protein relative to the PBS control. Further, the antisense compound conjugated to GalNAc$_3$-1 (ISIS 647535) was substantially more potent than the antisense compound lacking the GalNAc$_3$-1 conjugate (ISIS 304801).

TABLE 19

Effect of ASO treatment on ApoC III plasma protein levels in human ApoC III transgenic mice

| ASO | Dose (μmol/kg) | % PBS | $ED_{50}$ (μmol/kg) | 3' Conjugate | Internucleoside Linkage/Length | SEQ ID No. |
|---|---|---|---|---|---|---|
| PBS | 0 | 100 | — | — | — | |
| ISIS 304801 | 0.08 | 86 | 0.73 | None | PS/20 | 2248 |
| | 0.75 | 51 | | | | |
| | 2.25 | 23 | | | | |
| | 6.75 | 13 | | | | |
| ISIS 647535 | 0.08 | 72 | 0.19 | GalNAc$_3$-1 | PS/20 | 2249 |
| | 0.75 | 14 | | | | |
| | 2.25 | 12 | | | | |
| | 6.75 | 11 | | | | |

Plasma triglycerides and cholesterol were extracted by the method of Bligh and Dyer (Bligh, E. G. and Dyer, W. J. Can. J. Biochem. Physiol. 37: 911-917, 1959)(Bligh, E and Dyer, W, Can J Biochem Physiol, 37, 911-917, 1959)(Bligh, E and Dyer, W, Can J Biochem Physiol, 37, 911-917, 1959) and measured by using a Beckmann Coulter clinical analyzer and commercially available reagents.

The triglyceride levels were measured relative to PBS injected mice and are denoted as "% PBS". Results are presented in Table 20. As illustrated, both antisense compounds lowered triglyceride levels. Further, the antisense compound conjugated to GalNAc$_3$-1 (ISIS 647535) was substantially more potent than the antisense compound lacking the GalNAc$_3$-1 conjugate (ISIS 304801).

TABLE 20

Effect of ASO treatment on triglyceride levels in transgenic mice

| ASO | Dose (μmol/kg) | % PBS | $ED_{50}$ (μmol/kg) | 3' Conjugate | Internucleoside Linkage/Length | SEQ ID No. |
|---|---|---|---|---|---|---|
| PBS | 0 | 100 | — | — | — | |
| ISIS 304801 | 0.08 | 87 | 0.63 | None | PS/20 | 2248 |
| | 0.75 | 46 | | | | |
| | 2.25 | 21 | | | | |
| | 6.75 | 12 | | | | |
| ISIS 647535 | 0.08 | 65 | 0.13 | GalNAc$_3$-1 | PS/20 | 2249 |
| | 0.75 | 9 | | | | |
| | 2.25 | 8 | | | | |
| | 6.75 | 9 | | | | |

Plasma samples were analyzed by HPLC to determine the amount of total cholesterol and of different fractions of cholesterol (HDL and LDL). Results are presented in Tables 21 and 22. As illustrated, both antisense compounds lowered total cholesterol levels; both lowered LDL; and both raised HDL. Further, the antisense compound conjugated to GalNAc$_3$-1 (ISIS 647535) was substantially more potent than the antisense compound lacking the GalNAc$_3$-1 conjugate (ISIS 304801). An increase in HDL and a decrease in LDL levels is a cardiovascular beneficial effect of antisense inhibition of ApoC III.

TABLE 21

Effect of ASO treatment on total cholesterol levels in transgenic mice

| ASO | Dose (μmol/kg) | Total Cholesterol (mg/dL) | 3' Conjugate | Internucleoside Linkage/Length | SEQ ID No. |
|---|---|---|---|---|---|
| PBS | 0 | 257 | — | — | |
| ISIS 304801 | 0.08 | 226 | None | PS/20 | 2248 |
| | 0.75 | 164 | | | |
| | 2.25 | 110 | | | |
| | 6.75 | 82 | | | |
| ISIS 647535 | 0.08 | 230 | GalNAc$_3$-1 | PS/20 | 2249 |
| | 0.75 | 82 | | | |
| | 2.25 | 86 | | | |
| | 6.75 | 99 | | | |

TABLE 22

Effect of ASO treatment on HDL and LDL cholesterol levels in transgenic mice

| ASO | Dose (μmol/kg) | HDL (mg/dL) | LDL (mg/dL) | 3' Conjugate | Internucleoside Linkage/Length | SEQ ID No. |
|---|---|---|---|---|---|---|
| PBS | 0 | 17 | 28 | — | — | |
| ISIS 304801 | 0.08 | 17 | 23 | None | PS/20 | 2248 |
| | 0.75 | 27 | 12 | | | |
| | 2.25 | 50 | 4 | | | |
| | 6.75 | 45 | 2 | | | |
| ISIS 647535 | 0.08 | 21 | 21 | GalNAc$_3$-1 | PS/20 | 2249 |
| | 0.75 | 44 | 2 | | | |
| | 2.25 | 50 | 2 | | | |
| | 6.75 | 58 | 2 | | | |

Pharmacokinetics Analysis (PK)

The PK of the ASOs was also evaluated. Liver and kidney samples were minced and extracted using standard protocols. Samples were analyzed on MSD1 utilizing IP-HPLC-MS. The tissue level (μg/g) of full-length ISIS 304801 and 647535 was measured and the results are provided in Table 23. As illustrated, liver concentrations of total full-length antisense compounds were similar for the two antisense compounds. Thus, even though the GalNAc$_3$-1-conjugated antisense compound is more active in the liver (as demonstrated by the RNA and protein data above), it is not present at substantially higher concentration in the liver. Indeed, the calculated EC$_{50}$ (provided in Table 23) confirms that the observed increase in potency of the conjugated compound cannot be entirely attributed to increased accumulation. This result suggests that the conjugate improved potency by a mechanism other than liver accumulation alone, possibly by improving the productive uptake of the antisense compound into cells.

The results also show that the concentration of GalNAc$_3$-1 conjugated antisense compound in the kidney is lower than that of antisense compound lacking the GalNAc conjugate. This has several beneficial therapeutic implications. For therapeutic indications where activity in the kidney is not sought, exposure to kidney risks kidney toxicity without corresponding benefit. Moreover, high concentration in kidney typically results in loss of compound to the urine resulting in faster clearance. Accordingly, for non-kidney targets, kidney accumulation is undesired. These data suggest that GalNAc$_3$-1 conjugation reduces kidney accumulation.

Metabolites of ISIS 647535 were also identified and their masses were confirmed by high resolution mass spectrometry analysis. The cleavage sites and structures of the observed metabolites are shown below. The relative % of full length ASO was calculated using standard procedures and the results are presented in Table 23a. The major metabolite of ISIS 647535 was full-length ASO lacking the entire conjugate (i.e. ISIS 304801), which results from cleavage at cleavage site A, shown below. Further, additional metabolites resulting from other cleavage sites were also observed. These results suggest that introducing other cleavable bonds such as esters, peptides, disulfides, phosphoramidates or acyl-hydrazones between the GalNAc$_3$-1 sugar and the ASO, which can be cleaved by enzymes inside the cell, or which may cleave in the reductive environment of the cytosol, or which are labile to the acidic pH inside endosomes and lyzosomes, can also be useful.

TABLE 23a

Observed full length metabolites of ISIS 647535

| Metabolite | ASO | Cleavage site | Relative % |
|---|---|---|---|
| 1 | ISIS 304801 | A | 36.1 |
| 2 | ISIS 304801 + dA | B | 10.5 |
| 3 | ISIS 647535 minus [3 GalNAc] | C | 16.1 |
| 4 | ISIS 647535 minus [3 GalNAc + 1 5-hydroxy-pentanoic acid tether] | D | 17.6 |
| 5 | ISIS 647535 minus [2 GalNAc + 2 5-hydroxy-pentanoic acid tether] | D | 9.9 |
| 6 | ISIS 647535 minus [3 GalNAc + 3 5-hydroxy-pentanoic acid tether] | D | 9.8 |

TABLE 23

PK analysis of ASO treatment in transgenic mice

| ASO | Dose (μmol/kg) | Liver (μg/g) | Kidney (μg/g) | Liver EC$_{50}$ (μg/g) | 3' Conjugate | Internucleoside Linkage/Length | SEQ ID No. |
|---|---|---|---|---|---|---|---|
| ISIS 304801 | 0.1 | 5.2 | 2.1 | 53 | None | PS/20 | 2248 |
| | 0.8 | 62.8 | 119.6 | | | | |
| | 2.3 | 142.3 | 191.5 | | | | |
| | 6.8 | 202.3 | 337.7 | | | | |
| ISIS 647535 | 0.1 | 3.8 | 0.7 | 3.8 | GalNAc$_3$-1 | PS/20 | 2249 |
| | 0.8 | 72.7 | 34.3 | | | | |
| | 2.3 | 106.8 | 111.4 | | | | |
| | 6.8 | 237.2 | 179.3 | | | | |

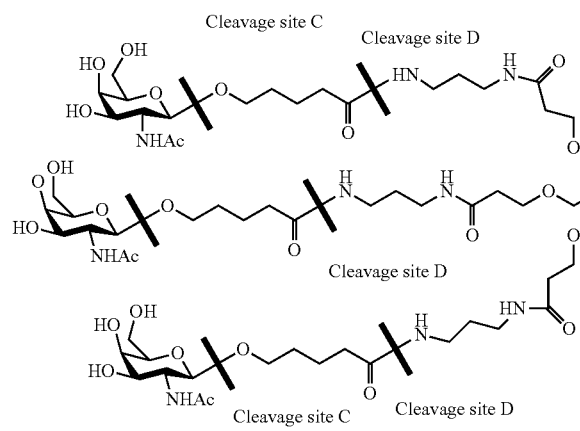
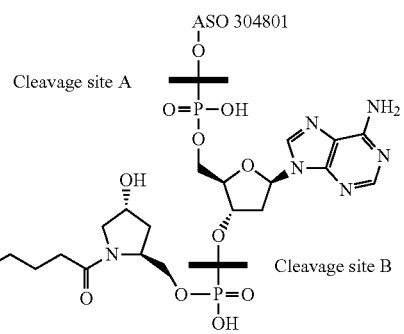
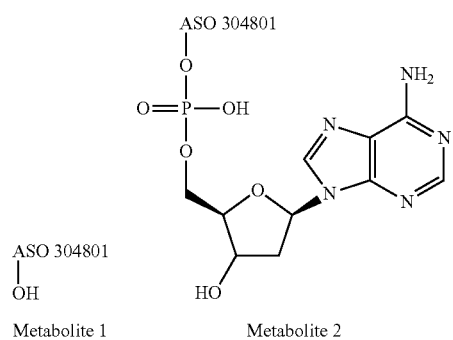
Metabolite 1   Metabolite 2
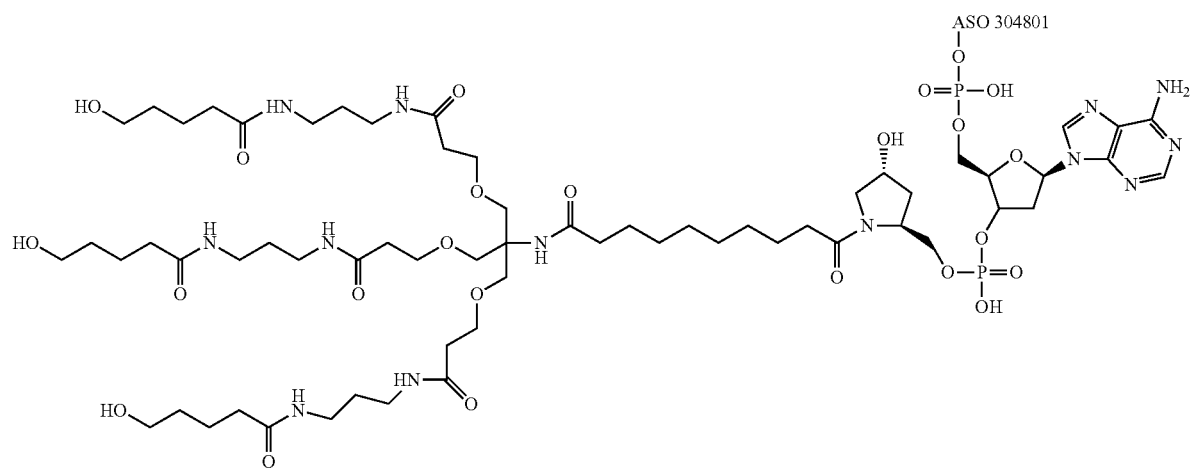
Metabolite 3

-continued
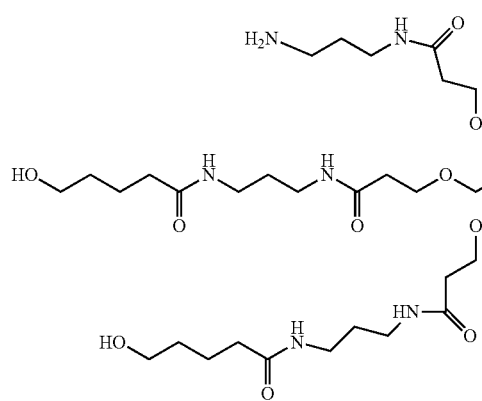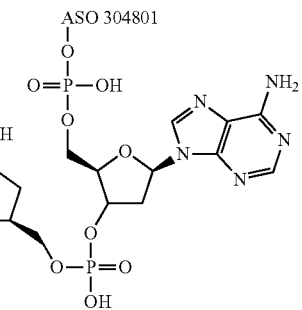
Metabolite 4
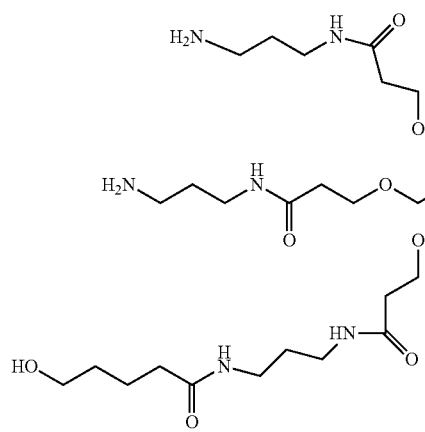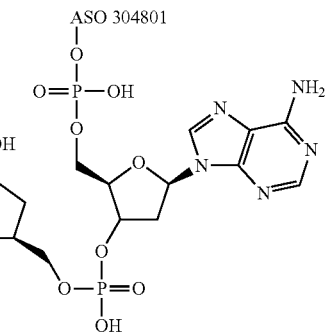
Metabolite 5
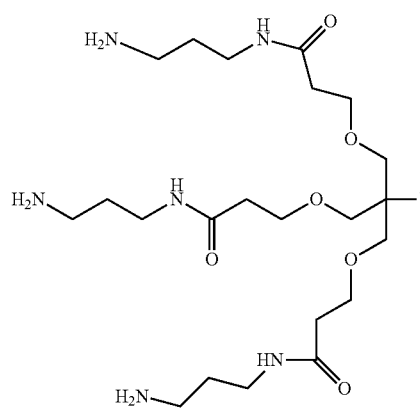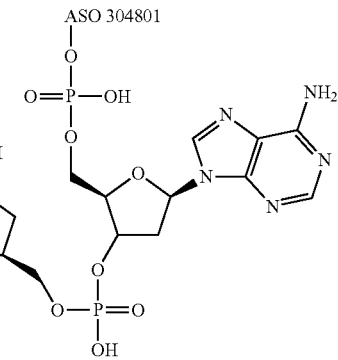
Metabolite 6

Example 21

Antisense Inhibition of Human ApoC III in Human ApoC III Transgenic Mice in Single Administration Study ISIS 304801, 647535 and 647536 each targeting human ApoC III and described in Table 17, were further evaluated in a single administration study for their ability to inhibit human ApoC III in human ApoC III transgenic mice.

Treatment

Human ApoCIII transgenic mice were maintained on a 12-hour light/dark cycle and fed ad libitum Teklad lab chow. Animals were acclimated for at least 7 days in the research facility before initiation of the experiment. ASOs were prepared in PBS and sterilized by filtering through a 0.2 micron filter. ASOs were dissolved in 0.9% PBS for injection.

Human ApoC III transgenic mice were injected intraperitoneally once at the dosage shown below with ISIS 304801, 647535 or 647536 (described above) or with PBS treated control. The treatment group consisted of 3 animals and the control group consisted of 4 animals. Prior to the treatment as well as after the last dose, blood was drawn from each mouse and plasma samples were analyzed. The mice were sacrificed 72 hours following the last administration.

Samples were collected and analyzed to determine the ApoC III mRNA and protein levels in the liver; plasma triglycerides; and cholesterol, including HDL and LDL fractions were assessed as described above (Example 20). Data from those analyses are presented in Tables 24-28, below. Liver transaminase levels, alanine aminotransferase (ALT) and aspartate aminotransferase (AST), in serum were measured relative to saline injected mice using standard protocols. The ALT and AST levels showed that the antisense compounds were well tolerated at all administered doses.

These results show improvement in potency for antisense compounds comprising a GalNAc$_3$-1 conjugate at the 3' terminus (ISIS 647535 and 647536) compared to the antisense compound lacking a GalNAc$_3$-1 conjugate (ISIS 304801). Further, ISIS 647536, which comprises a GalNAc$_3$-1 conjugate and some phosphodiester linkages was as potent as ISIS 647535, which comprises the same conjugate and all internucleoside linkages within the ASO are phosphorothioate.

TABLE 24

Effect of ASO treatment on ApoC III mRNA levels in human ApoC III transgenic mice

| ASO | Dose (mg/kg) | % PBS | ED$_{50}$ (mg/kg) | 3' Conjugate | Internucleoside linkage/Length | SEQ ID No. |
|---|---|---|---|---|---|---|
| PBS | 0 | 99 | — | — | — | |
| ISIS 304801 | 1 | 104 | 13.2 | None | PS/20 | 2248 |
| | 3 | 92 | | | | |
| | 10 | 71 | | | | |
| | 30 | 40 | | | | |
| ISIS 647535 | 0.3 | 98 | 1.9 | GalNAc$_3$-1 | PS/20 | 2249 |
| | 1 | 70 | | | | |
| | 3 | 33 | | | | |
| | 10 | 20 | | | | |
| ISIS 647536 | 0.3 | 103 | 1.7 | GalNAc$_3$-1 | PS/PO/20 | 2249 |
| | 1 | 60 | | | | |
| | 3 | 31 | | | | |
| | 10 | 21 | | | | |

TABLE 25

Effect of ASO treatment on ApoC III plasma protein levels in human ApoC III transgenic mice

| ASO | Dose (mg/kg) | % PBS | ED$_{50}$ (mg/kg) | 3' Conjugate | Internucleoside Linkage/Length | SEQ ID No. |
|---|---|---|---|---|---|---|
| PBS | 0 | 99 | — | — | — | |
| ISIS 304801 | 1 | 104 | 23.2 | None | PS/20 | 2248 |
| | 3 | 92 | | | | |
| | 10 | 71 | | | | |
| | 30 | 40 | | | | |
| ISIS 647535 | 0.3 | 98 | 2.1 | GalNAc$_3$-1 | PS/20 | 2249 |
| | 1 | 70 | | | | |
| | 3 | 33 | | | | |
| | 10 | 20 | | | | |
| ISIS 647536 | 0.3 | 103 | 1.8 | GalNAc$_3$-1 | PS/PO/20 | 2249 |
| | 1 | 60 | | | | |
| | 3 | 31 | | | | |
| | 10 | 21 | | | | |

TABLE 26

Effect of ASO treatment on triglyceride levels in transgenic mice

| ASO | Dose (mg/kg) | % PBS | ED$_{50}$ (mg/kg) | 3' Conjugate | Internucleoside Linkage/Length | SEQ ID No. |
|---|---|---|---|---|---|---|
| PBS | 0 | 98 | — | — | — | |
| ISIS 304801 | 1 | 80 | 29.1 | None | PS/20 | 2248 |
| | 3 | 92 | | | | |
| | 10 | 70 | | | | |
| | 30 | 47 | | | | |
| ISIS 647535 | 0.3 | 100 | 2.2 | GalNAc$_3$-1 | PS/20 | 2249 |
| | 1 | 70 | | | | |
| | 3 | 34 | | | | |
| | 10 | 23 | | | | |
| ISIS 647536 | 0.3 | 95 | 1.9 | GalNAc$_3$-1 | PS/PO/20 | 2249 |
| | 1 | 66 | | | | |
| | 3 | 31 | | | | |
| | 10 | 23 | | | | |

TABLE 27

Effect of ASO treatment on total cholesterol levels in transgenic mice

| ASO | Dose (mg/kg) | % PBS | 3' Conjugate | Internucleoside Linkage/Length | SEQ ID No. |
|---|---|---|---|---|---|
| PBS | 0 | 96 | — | — | |
| ISIS 304801 | 1 | 104 | None | PS/20 | 2248 |
| | 3 | 96 | | | |
| | 10 | 86 | | | |
| | 30 | 72 | | | |
| ISIS 647535 | 0.3 | 93 | GalNAc$_3$-1 | PS/20 | 2249 |
| | 1 | 85 | | | |
| | 3 | 61 | | | |
| | 10 | 53 | | | |
| ISIS 647536 | 0.3 | 115 | GalNAc$_3$-1 | PS/PO/20 | 2249 |
| | 1 | 79 | | | |
| | 3 | 51 | | | |
| | 10 | 54 | | | |

TABLE 28

Effect of ASO treatment on HDL and LDL cholesterol levels in transgenic mice

| ASO | Dose (mg/kg) | HDL % PBS | LDL % PBS | 3' Conjugate | Internucleoside Linkage/Length | SEQ ID No. |
|---|---|---|---|---|---|---|
| PBS | 0 | 131 | 90 | — | — | |
| ISIS 304801 | 1 | 130 | 72 | None | PS/20 | 2248 |
| | 3 | 186 | 79 | | | |
| | 10 | 226 | 63 | | | |
| | 30 | 240 | 46 | | | |
| ISIS 647535 | 0.3 | 98 | 86 | GalNAc$_3$-1 | PS/20 | 2249 |
| | 1 | 214 | 67 | | | |
| | 3 | 212 | 39 | | | |
| | 10 | 218 | 35 | | | |
| ISIS 647536 | 0.3 | 143 | 89 | GalNAc$_3$-1 | PS/PO/20 | 2249 |
| | 1 | 187 | 56 | | | |
| | 3 | 213 | 33 | | | |
| | 10 | 221 | 34 | | | |

These results confirm that the GalNAc$_3$-1 conjugate improves potency of an antisense compound. The results also show equal potency of a GalNAc$_3$-1 conjugated antisense compounds where the antisense oligonucleotides have mixed linkages (ISIS 647536 which has six phosphodiester linkages) and a full phosphorothioate version of the same antisense compound (ISIS 647535).

Phosphorothioate linkages provide several properties to antisense compounds. For example, they resist nuclease digestion and they bind proteins resulting in accumulation of compound in the liver, rather than in the kidney/urine. These are desirable properties, particularly when treating an indication in the liver. However, phosphorothioate linkages have also been associated with an inflammatory response. Accordingly, reducing the number of phosphorothioate linkages in a compound is expected to reduce the risk of inflammation, but also lower concentration of the compound in liver, increase concentration in the kidney and urine, decrease stability in the presence of nucleases, and lower overall potency. The present results show that a GalNAc$_3$-1 conjugated antisense compound where certain phosphorothioate linkages have been replaced with phosphodiester linkages is as potent against a target in the liver as a counterpart having full phosphorothioate linkages. Such compounds are expected to be less proinflammatory (See Example 24 describing an experiment showing reduction of PS results in reduced inflammatory effect).

Example 22

Effect of GalNAc$_3$-1 Conjugated Modified ASO Targeting SRB-1 In Vivo

ISIS 440762 and 651900, each targeting SRB-1 and described in Table 17, were evaluated in a dose-dependent study for their ability to inhibit SRB-1 in Balb/c mice. Treatment Six week old male Balb/c mice (Jackson Laboratory, Bar Harbor, Me.) were injected subcutaneously once at the dosage shown below with ISIS 440762, 651900 or with PBS treated control. Each treatment group consisted of 4 animals. The mice were sacrificed 48 hours following the final administration to determine the SRB-1 mRNA levels in liver using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS".

As illustrated in Table 29, both antisense compounds lowered SRB-1 mRNA levels. Further, the antisense compound comprising the GalNAc$_3$-1 conjugate (ISIS 651900) was substantially more potent than the antisense compound lacking the GalNAc$_3$-1 conjugate (ISIS 440762). These results demonstrate that the potency benefit of GalNAc$_3$-1 conjugates are observed using antisense oligonucleotides complementary to a different target and having different chemically modified nucleosides, in this instance modified nucleosides comprise constrained ethyl sugar moieties (a bicyclic sugar moiety).

TABLE 29

Effect of ASO treatment on SRB-1 mRNA levels in Balb/c mice

| ASO | Dose (mg/kg) | Liver % PBS | ED$_{50}$ (mg/kg) | 3' Conjugate | Internucleoside linkage/Length | SEQ ID No. |
|---|---|---|---|---|---|---|
| PBS | 0 | 100 | | — | — | |
| ISIS 440762 | 0.7 | 85 | 2.2 | None | PS/14 | 2250 |
| | 2 | 55 | | | | |
| | 7 | 12 | | | | |
| | 20 | 3 | | | | |
| ISIS 651900 | 0.07 | 98 | 0.3 | GalNAc$_3$-1 | PS/14 | 2251 |
| | 0.2 | 63 | | | | |
| | 0.7 | 20 | | | | |
| | 2 | 6 | | | | |
| | 7 | 5 | | | | |

Example 23

Human Peripheral Blood Mononuclear Cells (hPBMC) Assay Protocol

The hPBMC assay was performed using BD Vautainer CPT tube method. A sample of whole blood from volunteered donors with informed consent at US HealthWorks clinic (Faraday & El Camino Real, Carlsbad) was obtained and collected in 4-15 BD Vacutainer CPT 8 ml tubes (VWR Cat. #BD362753). The approximate starting total whole blood volume in the CPT tubes for each donor was recorded using the PBMC assay data sheet.

The blood sample was remixed immediately prior to centrifugation by gently inverting tubes 8-10 times. CPT tubes were centrifuged at rt (18-25° C.) in a horizontal (swing-out) rotor for 30 min. at 1500-1800 RCF with brake off (2700 RPM Beckman Allegra 6R). The cells were retrieved from the buffy coat interface (between Ficoll and polymer gel layers); transferred to a sterile 50 ml conical tube and pooled up to 5 CPT tubes/50 ml conical tube/donor. The cells were then washed twice with PBS (Ca$^{++}$, Mg$^{++}$ free; GIBCO). The tubes were topped up to 50 ml and mixed by inverting several times. The sample was then centrifuged at 330×g for 15 minutes at rt (1215 RPM in Beckman Allegra 6R) and aspirated as much supernatant as possible without disturbing pellet. The cell pellet was dislodged by gently swirling tube and resuspended cells in RPMI+10% FBS+pen/strep (~1 ml/10 ml starting whole blood volume). A 60 µl sample was pipette into a sample vial (Beckman Coulter) with 600 µl VersaLyse reagent (Beckman Coulter Cat#A09777) and was gently vortexed for 10-15 sec. The sample was allowed to incubate for 10 min. at rt and being mixed again before counting. The cell suspension was counted on Vicell XR cell viability analyzer (Beckman Coulter) using PBMC cell type (dilution factor of 1:11 was stored with other parameters). The live cell/ml and viability were recorded. The cell suspension was diluted to $1 \times 10^7$ live PBMC/ml in RPMI+10% FBS+pen/strep.

The cells were plated at $5 \times 10^5$ in 50 µl/well of 96-well tissue culture plate (Falcon Microtest). 50 µl/well of 2x concentration oligos/controls diluted in RPMI+10% FBS+pen/strep. was added according to experiment template (100 µl/well total). Plates were placed on the shaker and allowed to mix for approx. 1 min. After being incubated for 24 hrs at 37° C.; 5% $CO_2$, the plates were centrifuged at 400xg for 10 minutes before removing the supernatant for MSD cytokine assay (i.e. human IL-6, IL-10, IL-8 and MCP-1).

Example 24

Evaluation of Proinflammatory Effects in hPBMC Assay for GalNAc$_3$-1 Conjugated ASOs The antisense oligonucleotides (ASOs) listed in Table 30 were evaluated for proinflammatory effect in hPBMC assay using the protocol described in Example 23. ISIS 353512 is an internal standard known to be a high responder for IL-6 release in the assay. The hPBMCs were isolated from fresh, volunteered donors and were treated with ASOs at 0, 0.0128, 0.064, 0.32, 1.6, 8, 40 and 200 µM concentrations. After a 24 hr treatment, the cytokine levels were measured.

The levels of IL-6 were used as the primary readout. The $EC_{50}$ and $E_{max}$ was calculated using standard procedures. Results are expressed as the average ratio of $E_{max}/EC_{50}$ from two donors and is denoted as "$E_{max}/EC_{50}$." The lower ratio indicates a relative decrease in the proinflammatory response and the higher ratio indicates a relative increase in the proinflammatory response.

With regard to the test compounds, the least proinflammatory compound was the PS/PO linked ASO (ISIS 616468). The GalNAc$_3$-1 conjugated ASO, ISIS 647535 was slightly less proinflammatory than its non-conjugated counterpart ISIS 304801. These results indicate that incorporation of some PO linkages reduces proinflammatory reaction and addition of a GalNAc$_3$-1 conjugate does not make a compound more proinflammatory and may reduce proinflammatory response. Accordingly, one would expect that an antisense compound comprising both mixed PS/PO linkages and a GalNAc$_3$-1 conjugate would produce lower proinflammatory responses relative to full PS linked antisense compound with or without a GalNAc$_3$-1 conjugate. These results show that GalNAc$_3$-1 conjugated antisense compounds, particularly those having reduced PS content are less proinflammatory.

Together, these results suggest that a GalNAc$_3$-1 conjugated compound, particularly one with reduced PS content, can be administered at a higher dose than a counterpart full PS antisense compound lacking a GalNAc$_3$-1 conjugate. Since half-life is not expected to be substantially different for these compounds, such higher administration would result in less frequent dosing. Indeed such administration could be even less frequent, because the GalNAc$_3$-1 conjugated compounds are more potent (See Examples 20-22) and re-dosing is necessary once the concentration of a compound has dropped below a desired level, where such desired level is based on potency.

TABLE 30

Modified ASOs

| ASO | Sequence (5' to 3') | Target | SEQ ID No. |
|---|---|---|---|
| ISIS 104838 | G$_{es}$$^m$C$_{es}$T$_{es}$G$_{es}$A$_{es}$T$_{ds}$T$_{ds}$A$_{ds}$G$_{ds}$A$_{ds}$G$_{ds}$A$_{ds}$G$_{ds}$A$_{ds}$G$_{ds}$G$_{ds}$$^m$C$_{es}$$^m$C$_{es}$$^m$C$_e$ | TNFα | 2252 |
| ISIS 353512 | T$_{es}$$^m$C$_{es}$$^m$C$_{es}$$^m$C$_{ds}$A$_{ds}$T$_{ds}$T$_{ds}$T$_{ds}$$^m$C$_{ds}$A$_{ds}$G$_{ds}$G$_{ds}$A$_{ds}$G$_{ds}$A$_{ds}$$^m$C$_{ds}$$^m$C$_{ds}$T$_{es}$G$_{es}$G$_e$ | CRP | 2253 |
| ISIS 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | ApoC III | 2248 |
| ISIS 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do'}$-GalNAc$_3$-1$_a$ | ApoC III | 2249 |
| ISIS 616468 | A$_{es}$G$_{eo}$$^m$C$_{eo}$T$_{eo}$T$_{eo}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{eo}$T$_{eo}$T$_{es}$A$_{es}$T$_e$ | ApoC III | 2248 |

Subscripts: "e" indicates 2'-MOE modified nucleoside; "d" indicates β-D-2'-deoxyribonucleoside; "k" indicates 6'-(S)—CH$_3$ bicyclic nucleoside (e.g. cEt); "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. "A$_{do'}$-GalNAc$_3$-1$_a$" indicates a conjugate having the structure GalNAc$_3$-1 shown in Example 9 attached to the 3'-end of the antisense oligonucleotide, as indicated.

TABLE 31

Proinflammatory Effect of ASOs targeting ApoC III in hPBMC assay

| ASO | $EC_{50}$ (µM) | $E_{max}$ (µM) | $E_{max}/EC_{50}$ | 3' Conjugate | Internucleoside Linkage/Length | SEQ ID No. |
|---|---|---|---|---|---|---|
| ISIS 353512 (high responder) | 0.01 | 265.9 | 26,590 | None | PS/20 | 2253 |
| ISIS 304801 | 0.07 | 106.55 | 1,522 | None | PS/20 | 2248 |
| ISIS 647535 | 0.12 | 138 | 1,150 | GalNAc$_3$-1 | PS/20 | 2249 |
| ISIS 616468 | 0.32 | 71.52 | 224 | None | PS/PO/20 | 2248 |

Example 25

Effect of GalNAc$_3$-1 Conjugated Modified ASO Targeting Human ApoC III In Vitro ISIS 304801 and 647535 described above were tested in vitro. Primary hepatocyte cells from transgenic mice at a density of 25,000 cells per well were treated with 0.03, 0.08, 0.24, 0.74, 2.22, 6.67 and 20 µM concentrations of modified oligonucleotides. After a treatment period of approximately 16 hours, RNA was isolated from the cells and mRNA levels were measured by quantitative real-time PCR and the hApoC III mRNA levels were adjusted according to total RNA content, as measured by RIBOGREEN.

223

The IC$_{50}$ was calculated using the standard methods and the results are presented in Table 32. As illustrated, comparable potency was observed in cells treated with ISIS 647535 as compared to the control, ISIS 304801.

TABLE 32

Modified ASO targeting human ApoC III in primary hepatocytes

| ASO | IC$_{50}$ (μM) | 3' Conjugate | Internucleoside linkage/Length | SEQ ID No. |
|---|---|---|---|---|
| ISIS 304801 | 0.44 | None | PS/20 | 2248 |
| ISIS 647535 | 0.31 | GalNAc$_3$-1 | PS/20 | 2249 |

In this experiment, the large potency benefits of GalNAc$_3$-1 conjugation that are observed in vivo were not observed in vitro. Subsequent free uptake experiments in primary hepatocytes in vitro did show increased potency of oligonucleotides comprising various GalNAc conjugates relative to oligonucleotides that lacking the GalNAc conjugate. (see Examples 60, 82, and 92)

Example 26

Effect of PO/PS Linkages on ApoC III ASO Activity

Human ApoC III transgenic mice were injected intraperitoneally once at 25 mg/kg of ISIS 304801, or ISIS 616468 (both described above) or with PBS treated control once per week for two weeks. The treatment group consisted of 3 animals and the control group consisted of 4 animals. Prior to the treatment as well as after the last dose, blood was drawn from each mouse and plasma samples were analyzed. The mice were sacrificed 72 hours following the last administration.

Samples were collected and analyzed to determine the ApoC III protein levels in the liver as described above (Example 20). Data from those analyses are presented in Table 33, below.

These results show reduction in potency for antisense compounds with PO/PS (ISIS 616468) in the wings relative to full PS (ISIS 304801).

TABLE 33

Effect of ASO treatment on ApoC III protein levels in human ApoC III transgenic mice

| ASO | Dose (mg/kg) | % PBS | 3' Conjugate | Internucleoside linkage/Length | SEQ ID No. |
|---|---|---|---|---|---|
| PBS | 0 | 99 | — | — | |
| ISIS 304801 | 25 mg/kg/wk for 2 wks | 24 | None | Full PS | 2248 |
| ISIS 616468 | 25 mg/kg/wk for 2 wks | 40 | None | 14 PS/6 PO | 2248 |

Example 27

Compound 56

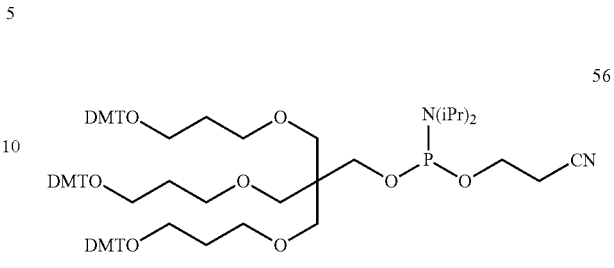

Compound 56 is commercially available from Glen Research or may be prepared according to published procedures reported by Shchepinov et al., *Nucleic Acids Research*, 1997, 25(22), 4447-4454.

Example 28

Preparation of Compound 60

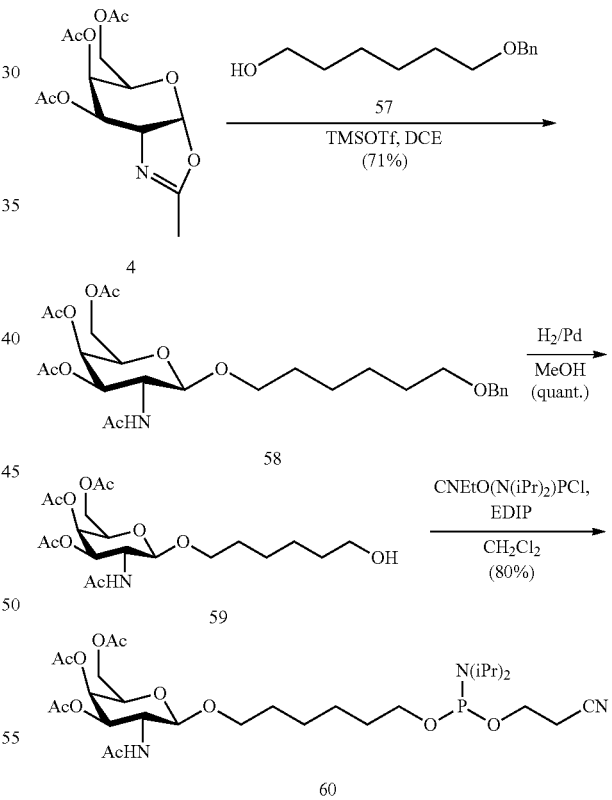

Compound 4 was prepared as per the procedures illustrated in Example 2. Compound 57 is commercially available. Compound 60 was confirmed by structural analysis.

Compound 57 is meant to be representative and not intended to be limiting as other monoprotected substituted or unsubstituted alkyl diols including but not limited to those presented in the specification herein can be used to prepare phosphoramidites having a predetermined composition.

Example 29

Preparation of Compound 63

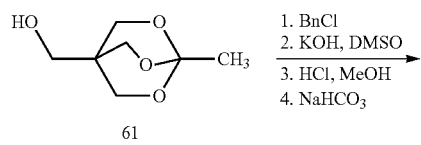

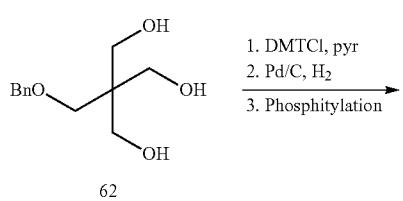

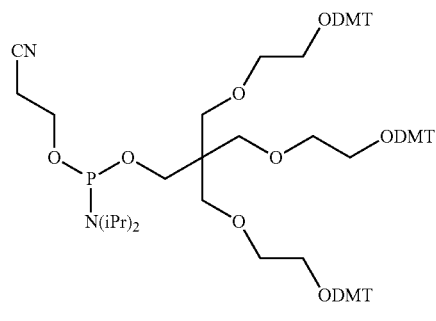

Compound 63a is prepared using procedures similar to those reported by Hanessian et al., *Canadian Journal of Chemistry*, 1996, 74(9), 1731-1737.

Example 31

Preparation of Compound 63d

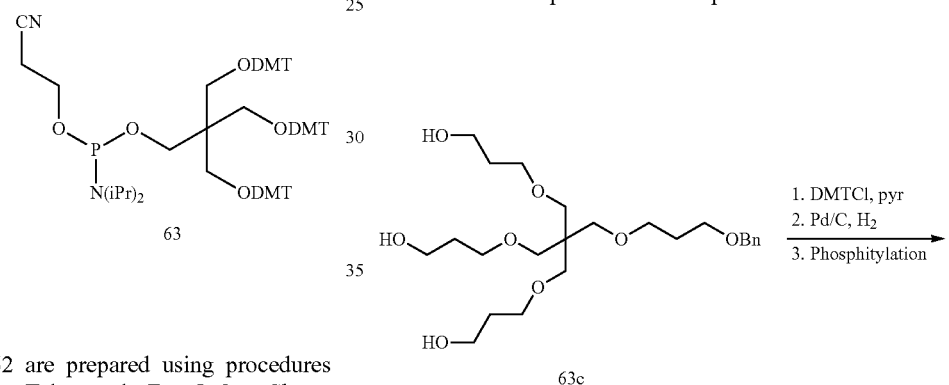

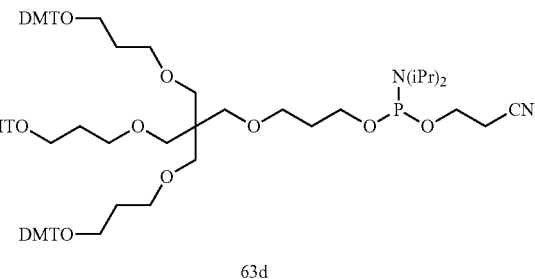

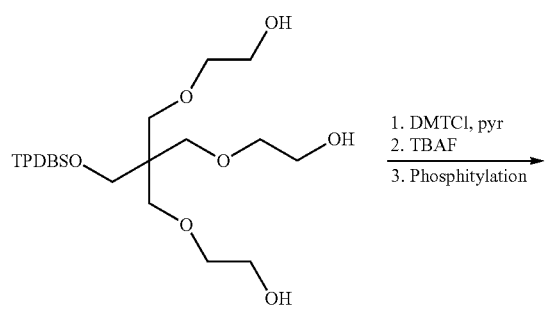

Compounds 61 and 62 are prepared using procedures similar to those reported by Tober et al., *Eur. J. Org. Chem.*, 2013, 3, 566-577; and Jiang et al., *Tetrahedron*, 2007, 63(19), 3982-3988.

Alternatively, Compound 63 is prepared using procedures similar to those reported in scientific and patent literature by Kim et al., *Synlett*, 2003, 12, 1838-1840; and Kim et al., published PCT International Application, WO 2004063208.

Example 30

Preparation of Compound 63b

Compound 63c is prepared using procedures similar to those reported by Chen et al., *Chinese Chemical Letters*, 1998, 9(5), 451-453.

Example 32

Preparation of Compound 67

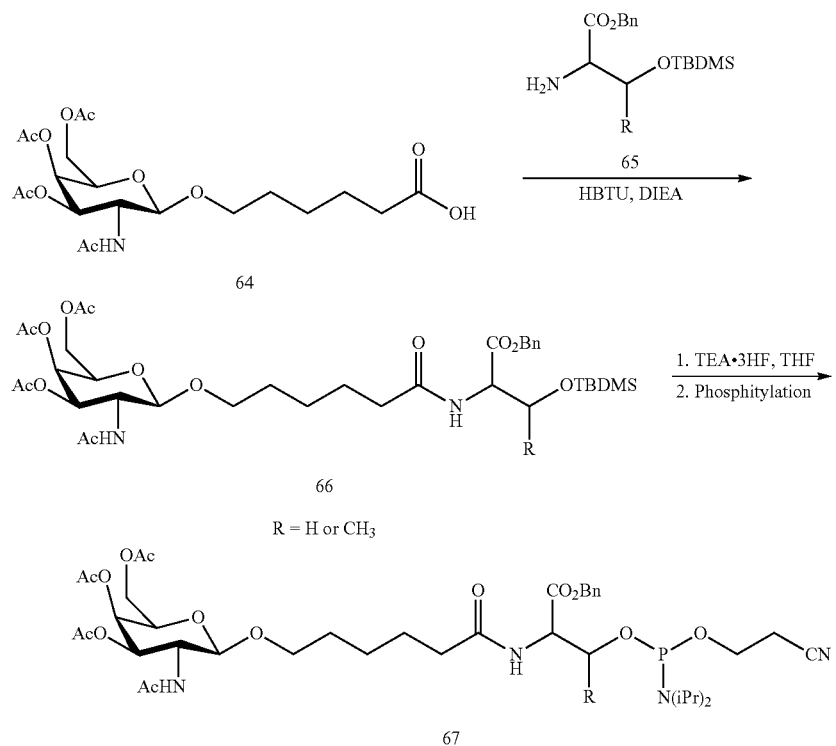

Compound 64 was prepared as per the procedures illustrated in Example 2. Compound 65 is prepared using procedures similar to those reported by Or et al., published PCT International Application, WO 2009003009. The protecting groups used for Compound 65 are meant to be representative and not intended to be limiting as other protecting groups including but not limited to those presented in the specification herein can be used.

Example 33

Preparation of Compound 70

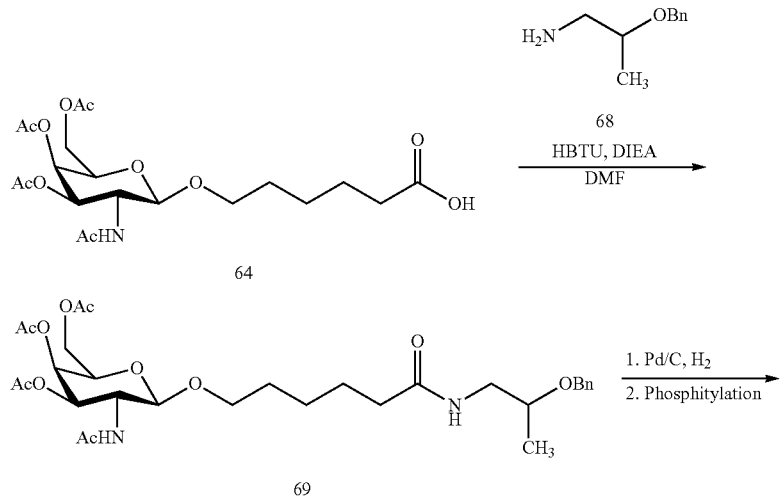

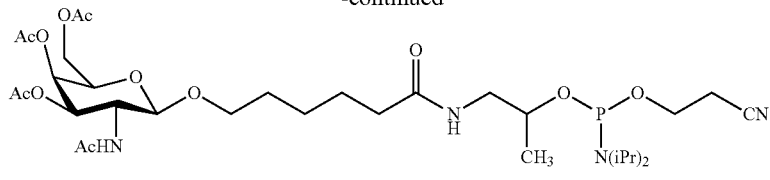

70

Compound 64 was prepared as per the procedures illustrated in Example 2. Compound 68 is commercially available. The protecting group used for Compound 68 is meant to be representative and not intended to be limiting as other protecting groups including but not limited to those presented in the specification herein can be used.

Example 34

Preparation of Compound 75a

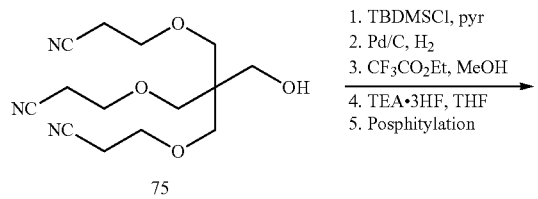

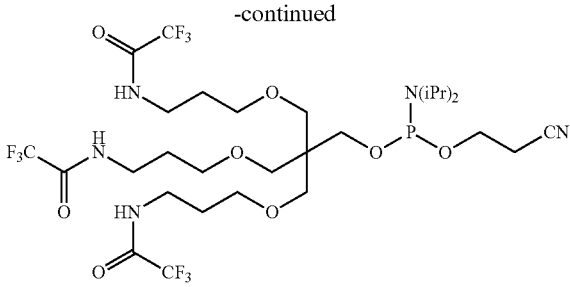

Compound 75 is prepared according to published procedures reported by Shchepinov et al., *Nucleic Acids Research*, 1997, 25(22), 4447-4454.

Example 35

Preparation of Compound 79

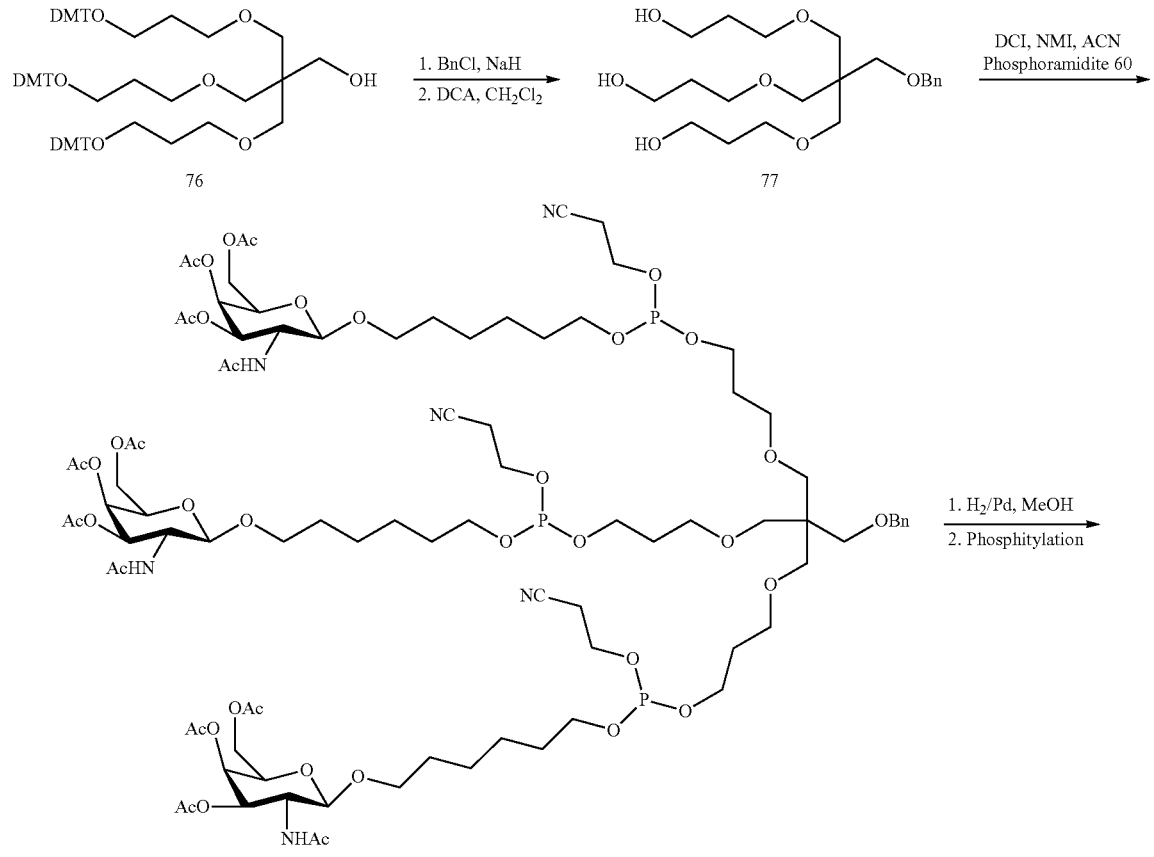

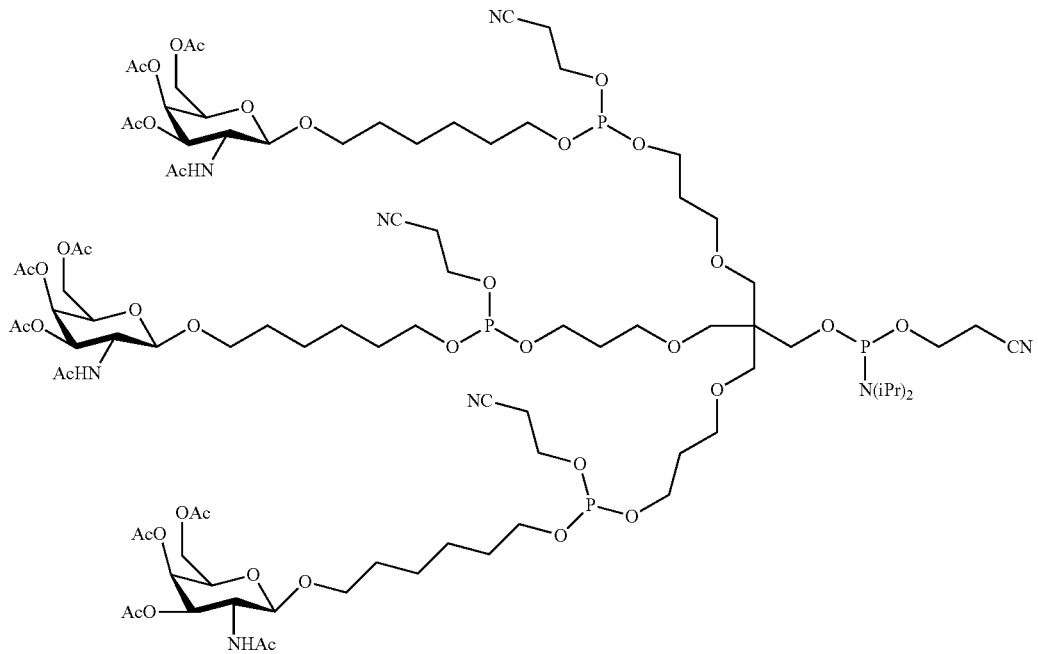

79

Compound 76 was prepared according to published procedures reported by Shchepinov et al., *Nucleic Acids Research*, 1997, 25(22), 4447-4454.

Example 36

Preparation of Compound 79a

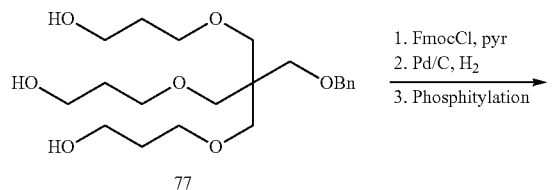

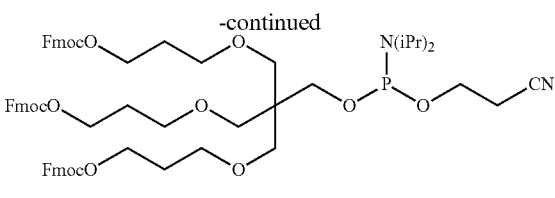

79a

Compound 77 is prepared as per the procedures illustrated in Example 35.

Example 37

General Method for the Preparation of Conjugated Oligomeric Compound 82 Comprising a Phosphodiester Linked GalNAc$_3$-2 Conjugate at 5' Terminus Via Solid Support (Method I)

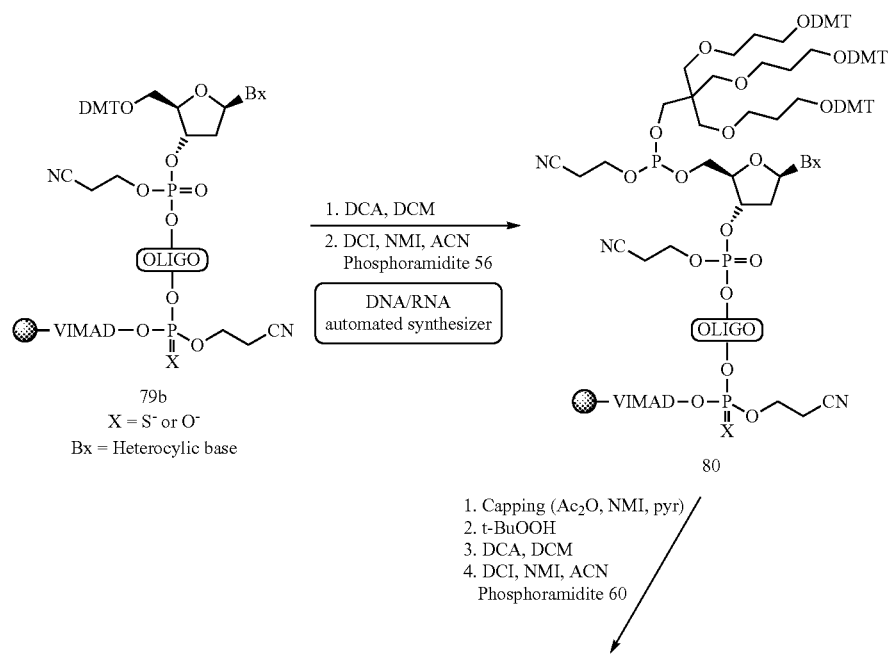
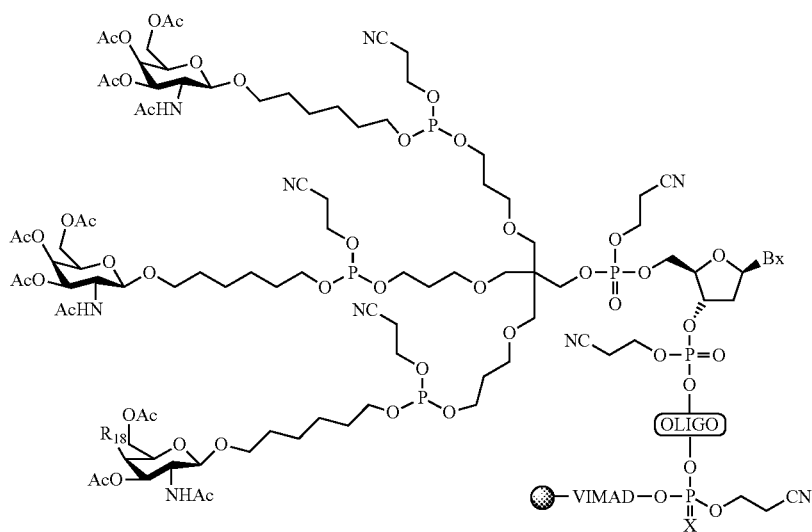

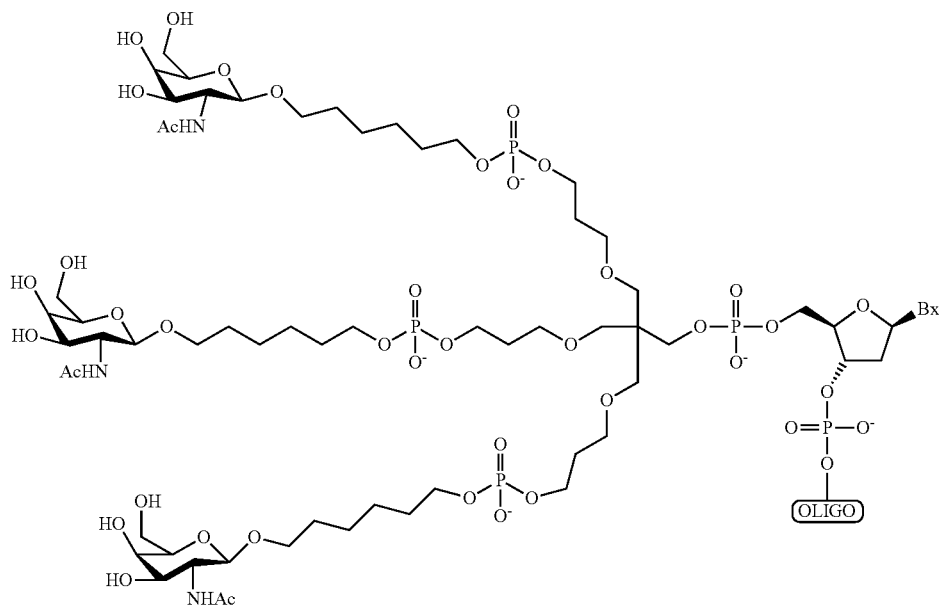
82
wherein GalNAc$_3$-2 has the structure:
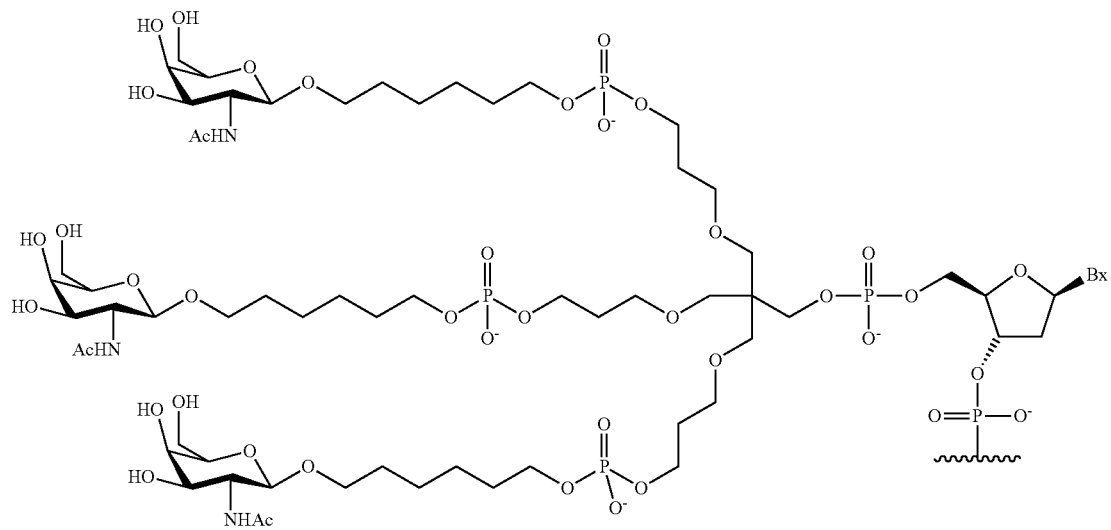
The GalNAc$_3$ cluster portion of the conjugate group GalNAc$_3$-2 (GalNAc$_3$-2$_a$) can be combined with any cleavable moiety to provide a variety of conjugate groups. Wherein GalNAc$_3$-2$_a$ has the formula:

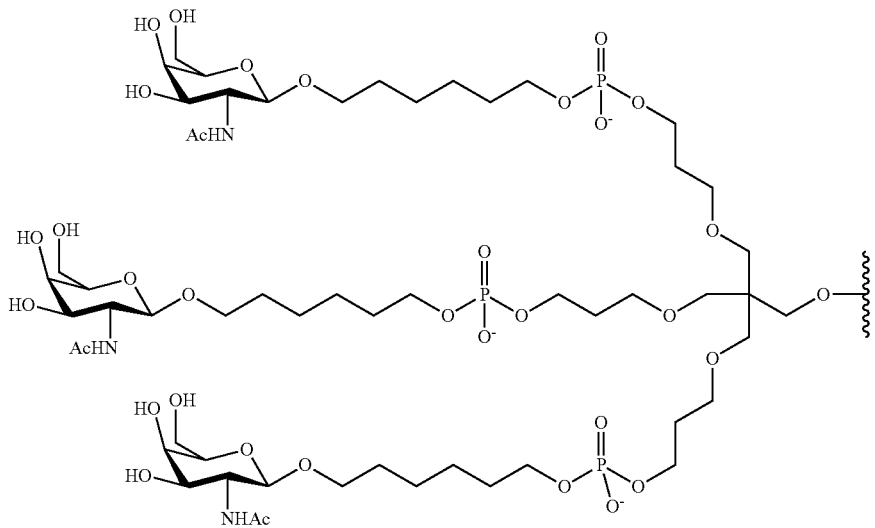

The VIMAD-bound oligomeric compound 79b was prepared using standard procedures for automated DNA/RNA synthesis (see Dupouy et al., *Angew. Chem. Int. Ed.*, 2006, 45, 3623-3627). The phosphoramidite Compounds 56 and 60 were prepared as per the procedures illustrated in Examples 27 and 28, respectively. The phosphoramidites illustrated are meant to be representative and not intended to be limiting as other phosphoramidite building blocks including but not limited those presented in the specification herein can be used to prepare an oligomeric compound having a phosphodiester linked conjugate group at the 5' terminus. The order and quantity of phosphoramidites added to the solid support can be adjusted to prepare the oligomeric compounds as described herein having any predetermined sequence and composition.

Example 38

Alternative Method for the Preparation of Oligomeric Compound 82 Comprising a Phosphodiester Linked GalNAc$_3$-2 Conjugate at 5' Terminus (Method II)

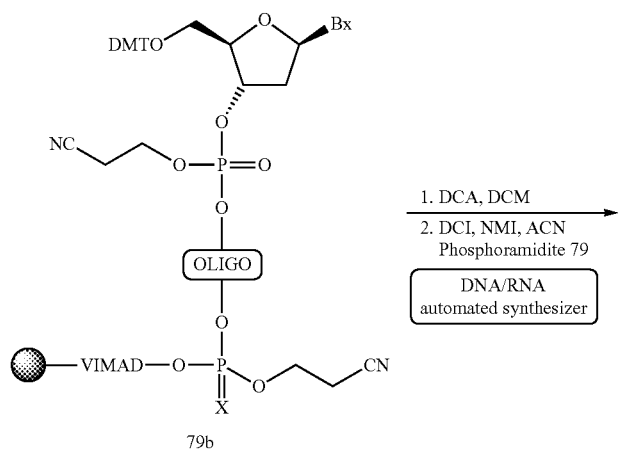

-continued

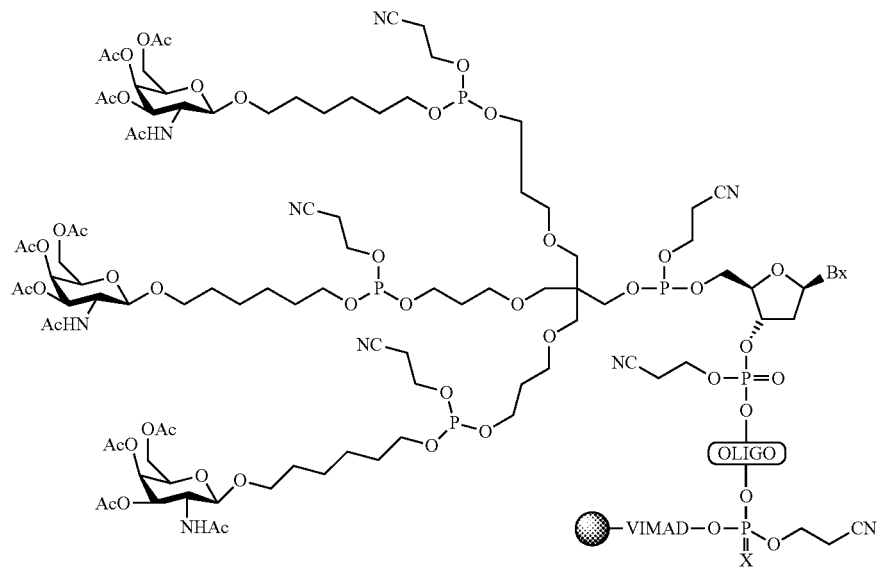

83

1. Capping
2. t-BuOOH
3. Et₃N:CH₃CN (1:1 v/v)
4. NH₄, 55° C.

Oligomeric Compound 82

X = S⁻ or O⁻
Bx = Heterocyclic base

The VIMAD-bound oligomeric compound 79b was prepared using standard procedures for automated DNA/RNA synthesis (see Dupouy et al., *Angew. Chem. Int. Ed.*, 2006, 45, 3623-3627). The GalNAc$_3$-2 cluster phosphoramidite, Compound 79 was prepared as per the procedures illustrated in Example 35. This alternative method allows a one-step installation of the phosphodiester linked GalNAc$_3$-2 conjugate to the oligomeric compound at the final step of the synthesis. The phosphoramidites illustrated are meant to be representative and not intended to be limiting, as other phosphoramidite building blocks including but not limited to those presented in the specification herein can be used to prepare oligomeric compounds having a phosphodiester conjugate at the 5' terminus. The order and quantity of phosphoramidites added to the solid support can be adjusted to prepare the oligomeric compounds as described herein having any predetermined sequence and composition.

Example 39

General Method for the Preparation of Oligomeric Compound 83h Comprising a GalNAc$_3$-3 Conjugate at the 5' Terminus (GalNAc$_3$-1 Modified for 5' End Attachment) Via Solid Support

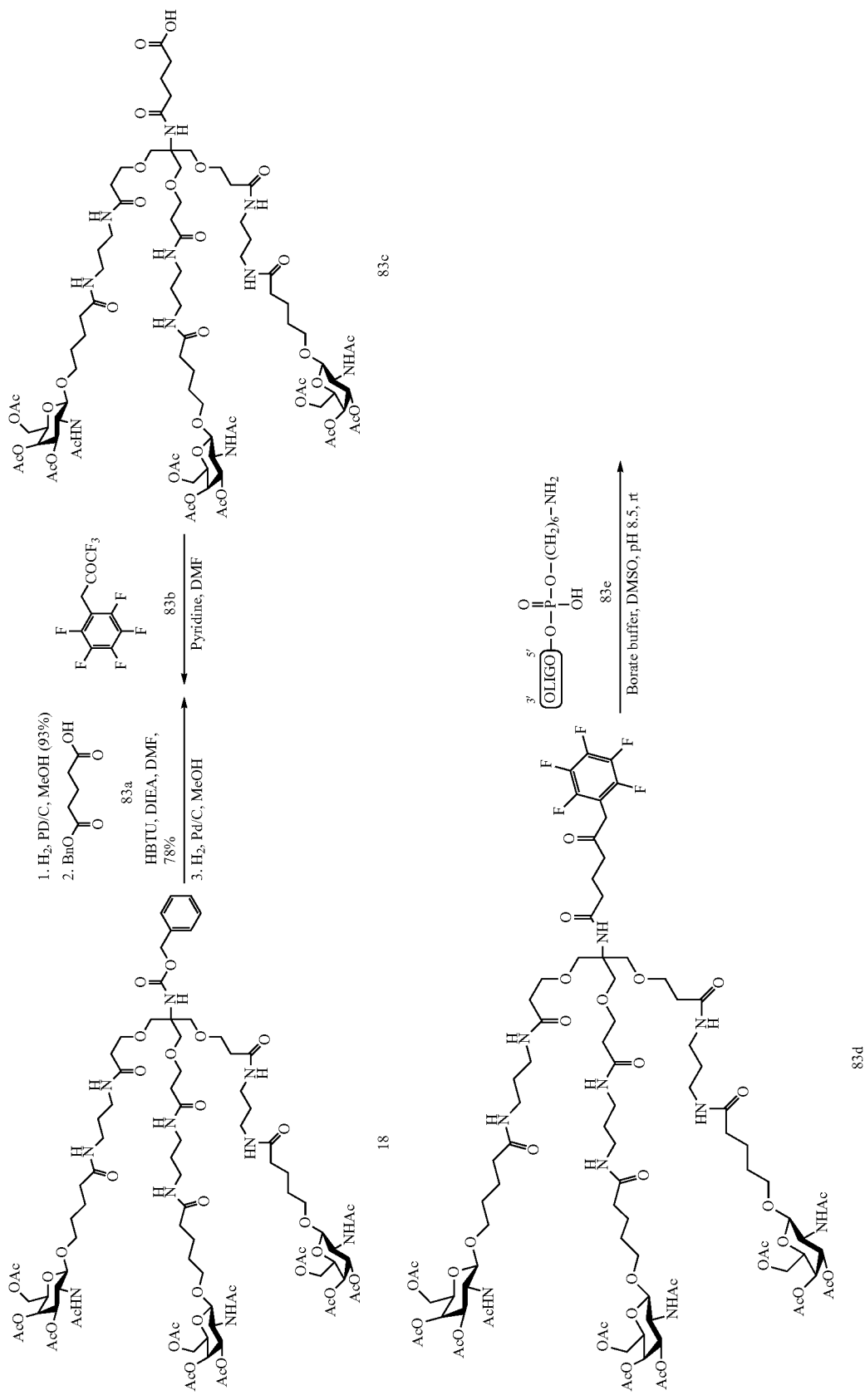

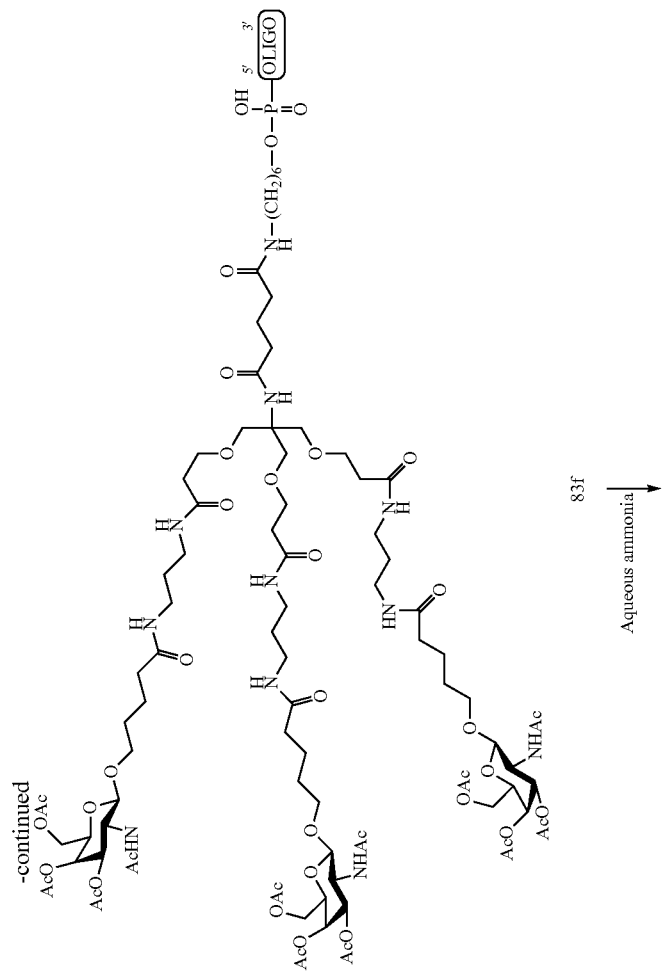

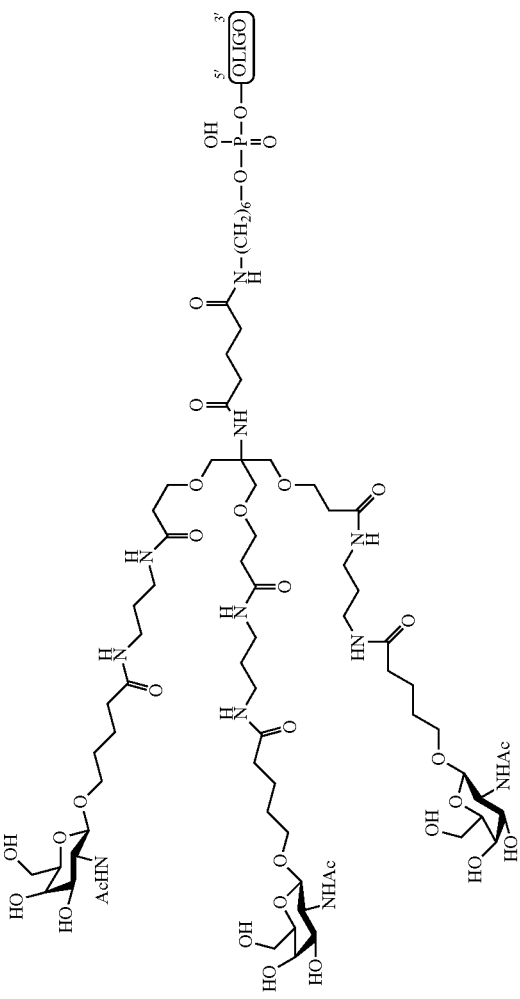
-continued
83h

Compound 18 was prepared as per the procedures illustrated in Example 4. Compounds 83a and 83b are commercially available. Oligomeric Compound 83e comprising a phosphodiester linked hexylamine was prepared using standard oligonucleotide synthesis procedures. Treatment of the protected oligomeric compound with aqueous ammonia provided the 5'-GalNAc$_3$-3 conjugated oligomeric compound (83h).

Wherein GalNAc$_3$-3 has the structure:

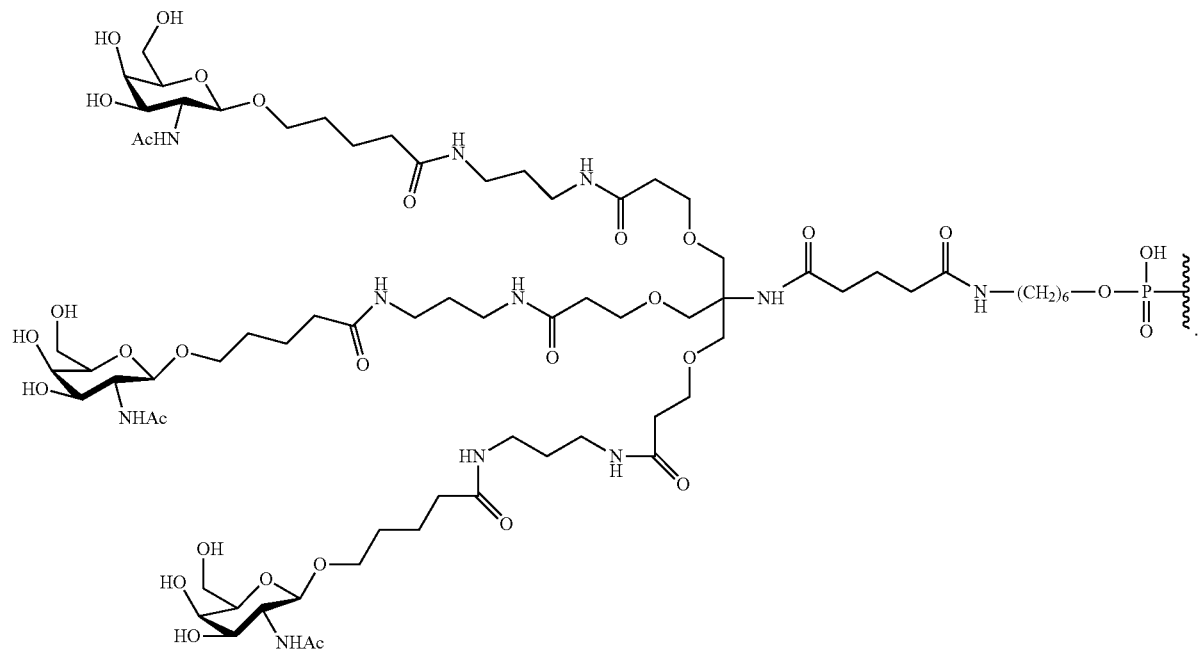

The GalNAc$_3$ cluster portion of the conjugate group GalNAc$_3$-3 (GalNAc$_3$-3$_a$) can be combined with any cleavable moiety to provide a variety of conjugate groups. Wherein GalNAc$_3$-3$_a$ has the formula:

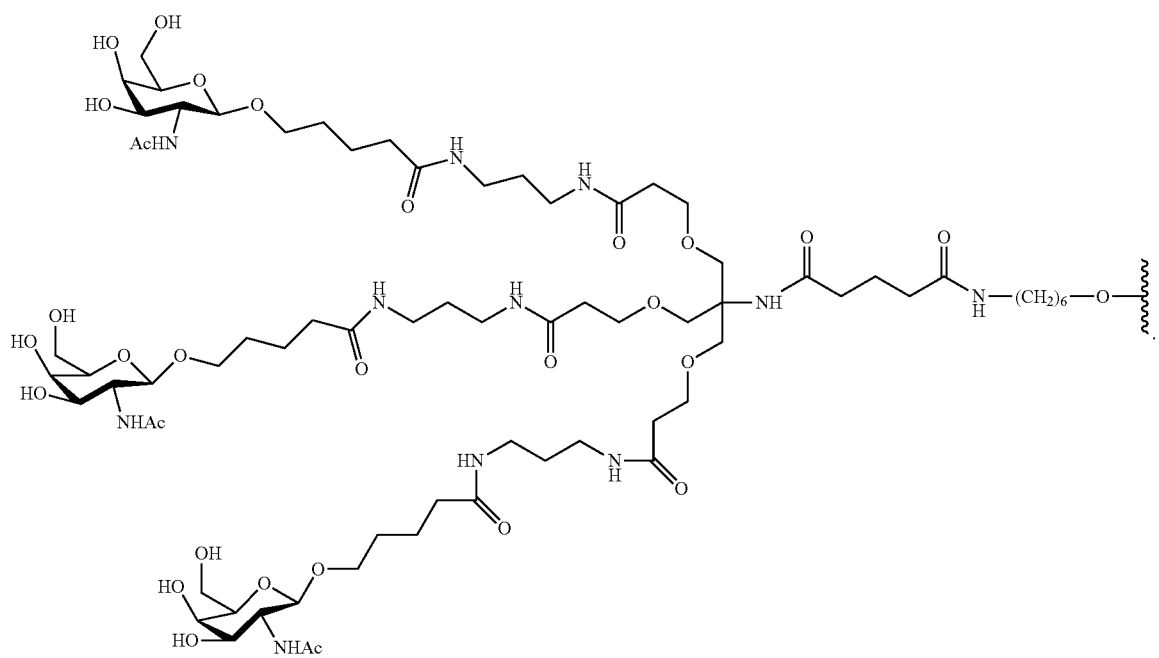

Example 40

General Method for the Preparation of Oligomeric Compound 89 Comprising a Phosphodiester Linked GalNAc$_3$-4 Conjugate at the 3' Terminus Via Solid Support

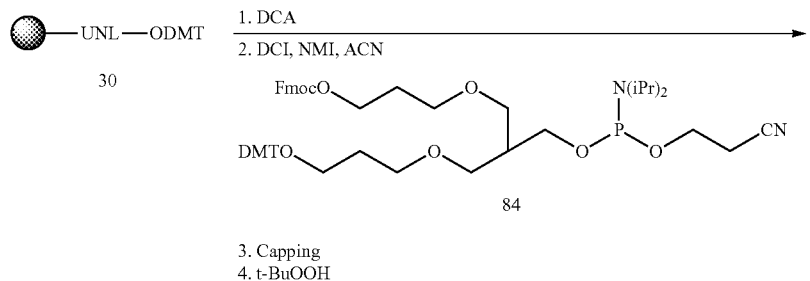

3. Capping
4. t-BuOOH

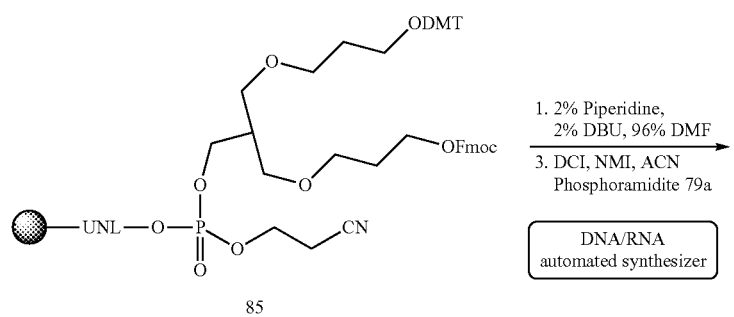

1. 2% Piperidine, 2% DBU, 96% DMF
3. DCI, NMI, ACN
   Phosphoramidite 79a

DNA/RNA automated synthesizer

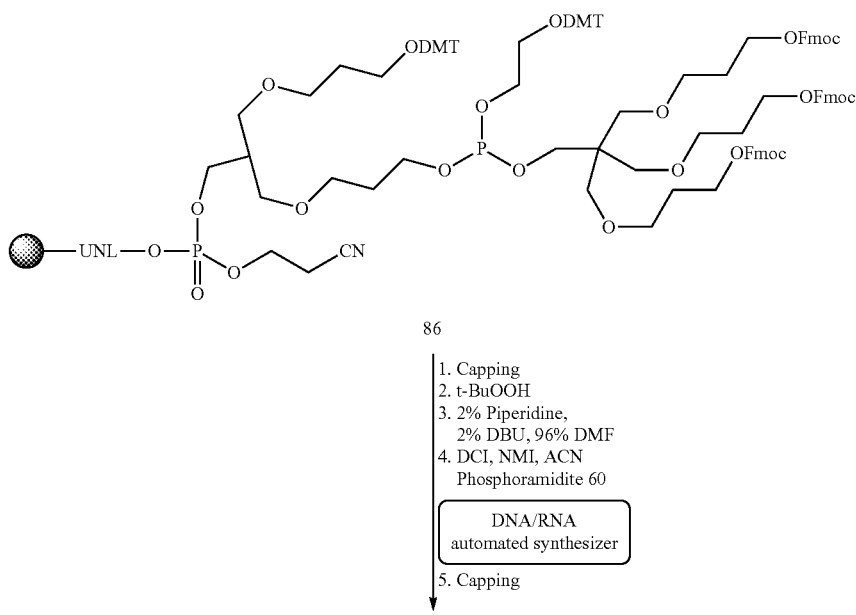

86

1. Capping
2. t-BuOOH
3. 2% Piperidine, 2% DBU, 96% DMF
4. DCI, NMI, ACN
   Phosphoramidite 60

DNA/RNA automated synthesizer

5. Capping

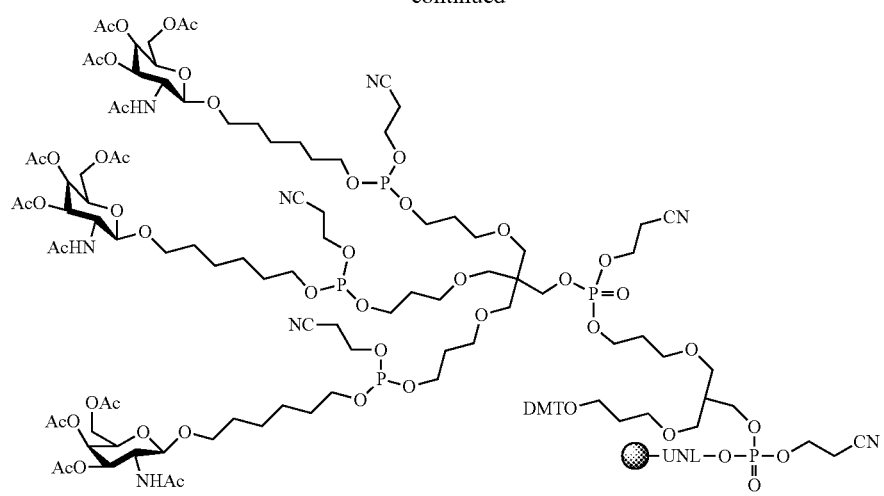
87
1. t-BuOOH
2. DCA
3. Oligo synthesis (DNA/RNA automated synthesizer)
4. Capping
5. Oxidation
6. Et$_3$N:CH$_3$CN (1:1, v/v)
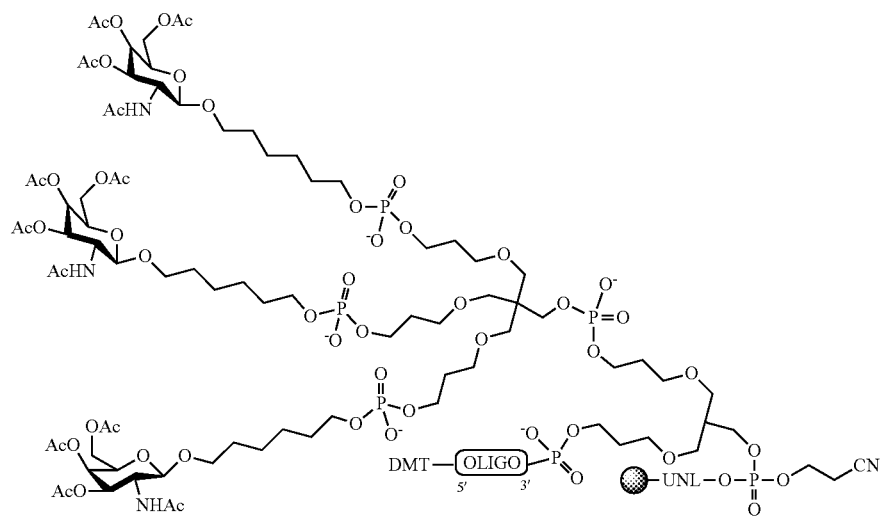
88
NH$_4$, 55° C.

-continued
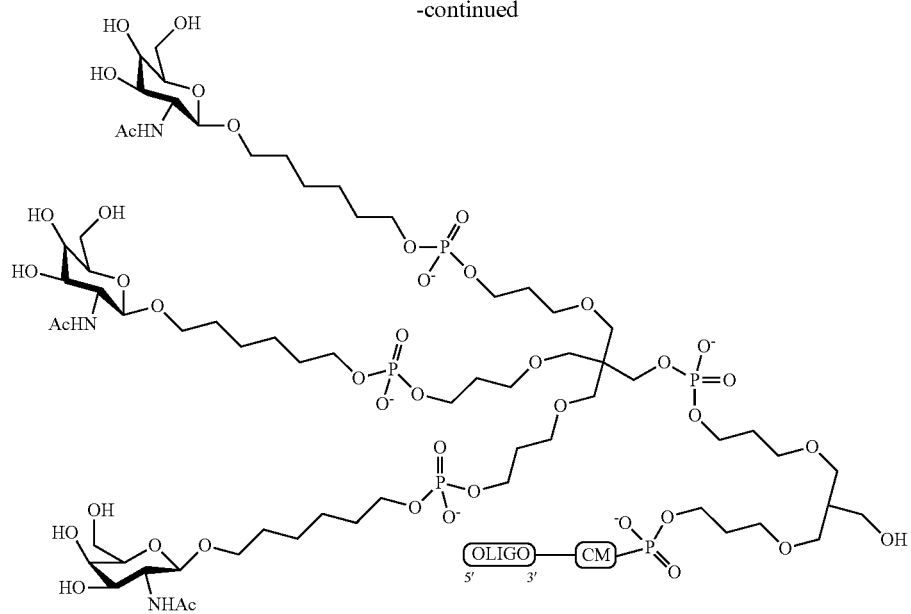
89
Wherein GalNAc₃-4 has the structure:
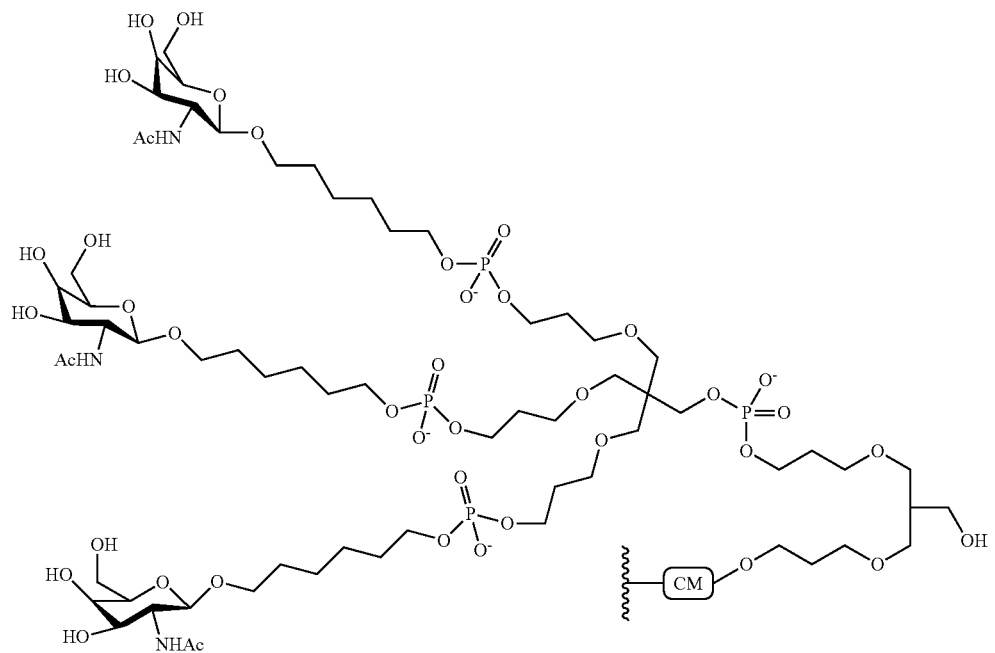
Wherein CM is a cleavable moiety. In certain embodiments, cleavable moiety is:

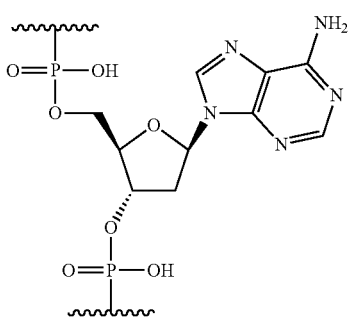

The GalNAc$_3$ cluster portion of the conjugate group GalNAc$_3$-4 (GalNAc$_3$-4$_a$) can be combined with any cleavable moiety to provide a variety of conjugate groups. Wherein GalNAc$_3$-4$_a$ has the formula:

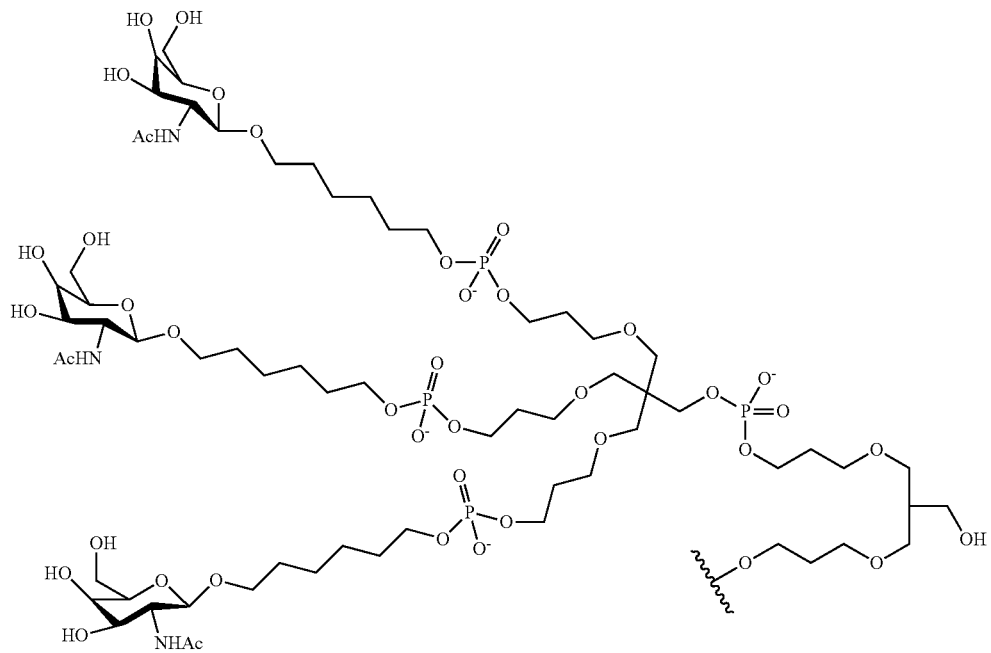

The protected Unylinker functionalized solid support Compound 30 is commercially available. Compound 84 is prepared using procedures similar to those reported in the literature (see Shchepinov et al., *Nucleic Acids Research*, 1997, 25(22), 4447-4454; Shchepinov et al., *Nucleic Acids Research*, 1999, 27, 3035-3041; and Hornet et al., *Nucleic Acids Research*, 1997, 25, 4842-4849).

The phosphoramidite building blocks, Compounds 60 and 79a are prepared as per the procedures illustrated in Examples 28 and 36. The phosphoramidites illustrated are meant to be representative and not intended to be limiting as other phosphoramidite building blocks can be used to prepare an oligomeric compound having a phosphodiester linked conjugate at the 3' terminus with a predetermined sequence and composition. The order and quantity of phosphoramidites added to the solid support can be adjusted to prepare the oligomeric compounds as described herein having any predetermined sequence and composition.

Example 41

General Method for the Preparation of ASOs Comprising a Phosphodiester Linked GalNAc$_3$-2 (See Example 37, Bx is Adenine) Conjugate at the 5' Position Via Solid Phase Techniques (Preparation of ISIS 661134)

Unless otherwise stated, all reagents and solutions used for the synthesis of oligomeric compounds are purchased from commercial sources. Standard phosphoramidite building blocks and solid support are used for incorporation nucleoside residues which include for example T, A, G, and $^m$C residues. Phosphoramidite compounds 56 and 60 were used to synthesize the phosphodiester linked GalNAc$_3$-2 conjugate at the 5' terminus. A 0.1 M solution of phosphoramidite in anhydrous acetonitrile was used for β-D-2'-deoxyribonucleoside and 2'-MOE.

The ASO syntheses were performed on ABI 394 synthesizer (1-2 μmol scale) or on GE Healthcare Bioscience ÄKTA oligopilot synthesizer (40-200 μmol scale) by the phosphoramidite coupling method on VIMAD solid support (110 μmol/g, Guzaev et al., 2003) packed in the column. For the coupling step, the phosphoramidites were delivered at a 4 fold excess over the initial loading of the solid support and phosphoramidite coupling was carried out for 10 min. All other steps followed standard protocols supplied by the manufacturer. A solution of 6% dichloroacetic acid in toluene was used for removing the dimethoxytrityl (DMT) groups from 5'-hydroxyl groups of the nucleotide. 4,5-Dicyanoimidazole (0.7 M) in anhydrous CH$_3$CN was used as activator during the coupling step. Phosphorothioate linkages were introduced by sulfurization with 0.1 M solution of xanthane hydride in 1:1 pyridine/CH$_3$CN for a contact time of 3 minutes. A solution of 20% tert-butylhydroperoxide in CH$_3$CN containing 6% water was used as an oxidizing agent to provide phosphodiester internucleoside linkages with a contact time of 12 minutes.

After the desired sequence was assembled, the cyanoethyl phosphate protecting groups were deprotected using a 20% diethylamine in toluene (v/v) with a contact time of 45 minutes. The solid-support bound ASOs were suspended in aqueous ammonia (28-30 wt %) and heated at 55° C. for 6 h.

The unbound ASOs were then filtered and the ammonia was boiled off. The residue was purified by high pressure liquid chromatography on a strong anion exchange column (GE Healthcare Bioscience, Source 30Q, 30 µm, 2.54×8 cm, A=100 mM ammonium acetate in 30% aqueous $CH_3CN$, B=1.5 M NaBr in A, 0-40% of B in 60 min, flow 14 mL min-1, $\lambda$=260 nm). The residue was desalted by HPLC on a reverse phase column to yield the desired ASOs in an isolated yield of 15-30% based on the initial loading on the solid support. The ASOs were characterized by ion-pair-HPLC coupled MS analysis with Agilent 1100 MSD system.

TABLE 34

ASO comprising a phosphodiester linked $GalNAc_3$-2 conjugate at the 5' position targeting SRB-1

| ISIS No. | Sequence (5' to 3') | CalCd Mass | Observed Mass | SEQ ID No. |
|---|---|---|---|---|
| 661134 | $GalNAc_3$-$2_{a-o'}A_{do}$ $T_{ks}{}^mC_{ks}A_{ds}G_{ds}T_{ds}$ ${}^mC_{ds}A_{ds}T_{ds}G_{ds}A_{ds}$ ${}^mC_{ds}T_{ds}T_{ks}{}^mC_k$ | 6482.2 | 6481.6 | 2254 |

Subscripts: "e" indicates 2'-MOE modified nucleoside; "d" indicates β-D-2'-deoxyribonucleoside; "k" indicates 6'-(S)—$CH_3$ bicyclic nucleoside (e.g. cEt); "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. The structure of $GalNAc_3$-$2_a$ is shown in Example 37.

Example 42

General Method for the Preparation of ASOs Comprising a $GalNAc_3$-3 Conjugate at the 5' Position Via Solid Phase Techniques (Preparation of ISIS 661166)

The synthesis for ISIS 661166 was performed using similar procedures as illustrated in Examples 39 and 41.

ISIS 661166 is a 5-10-5 MOE gapmer, wherein the 5' position comprises a $GalNAc_3$-3 conjugate. The ASO was characterized by ion-pair-HPLC coupled MS analysis with Agilent 1100 MSD system.

TABLE 34a

ASO comprising a $GalNAc_3$-3 conjugate at the 5' position via a hexylamino phosphodiester linkage targeting Malat-1

| ISIS No. | Sequence (5' to 3') | Conjugate | Calcd Mass | Observed Mass | SEQ ID No. |
|---|---|---|---|---|---|
| 661166 | 5'-$GalNAc_3$-$3_{a-o'}{}^mC_{es}G_{es}$ $G_{es}T_{es}G_{es}{}^mC_{ds}$ $A_{ds}A_{ds}G_{ds}G_{ds}$ ${}^mC_{ds}T_{ds}T_{ds}A_{ds}$ $G_{ds}G_{es}A_{es}A_{es}$ $T_{es}T_e$ | 5'-$GalNAc_3$-3 | 8992.16 | 8990.51 | 2255 |

Subscripts: "e" indicates 2'-MOE modified nucleoside; "d" indicates β-D-2'-deoxyribonucleoside; "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. The structure of "5'-$GalNAc_3$-3a" is shown in Example 39.

Example 43

Dose-dependent Study of Phosphodiester Linked $GalNAc_3$-2 (See Examples 37 and 41, Bx is Adenine) at the 5' Terminus Targeting SRB-1 In Vivo ISIS 661134 (see Example 41) comprising a phosphodiester linked $GalNAc_3$-2 conjugate at the 5' terminus was tested in a dose-dependent study for antisense inhibition of SRB-1 in mice. Unconjugated ISIS 440762 and 651900 ($GalNAc_3$-1 conjugate at 3' terminus, see Example 9) were included in the study for comparison and are described previously in Table 17.

Treatment

Six week old male Balb/c mice (Jackson Laboratory, Bar Harbor, Me.) were injected subcutaneously once at the dosage shown below with ISIS 440762, 651900, 661134 or with PBS treated control. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS". The $ED_{50}$s were measured using similar methods as described previously and are presented below.

As illustrated in Table 35, treatment with antisense oligonucleotides lowered SRB-1 mRNA levels in a dose-dependent manner. Indeed, the antisense oligonucleotides comprising the phosphodiester linked $GalNAc_3$-2 conjugate at the 5' terminus (ISIS 661134) or the $GalNAc_3$-1 conjugate linked at the 3' terminus (ISIS 651900) showed substantial improvement in potency compared to the unconjugated antisense oligonucleotide (ISIS 440762). Further, ISIS 661134, which comprises the phosphodiester linked $GalNAc_3$-2 conjugate at the 5' terminus was equipotent compared to ISIS 651900, which comprises the $GalNAc_3$-1 conjugate at the 3' terminus.

TABLE 35

ASOs containing $GalNAc_3$-1 or $GalNAc_3$-2 targeting SRB-1

| ISIS No. | Dosage (mg/kg) | SRB-1 mRNA levels (% PBS) | ED50 (mg/kg) | Conjugate | SEQ ID No. |
|---|---|---|---|---|---|
| PBS | 0 | 100 | — | — | |
| 440762 | 0.2 | 116 | 2.58 | No conjugate | 2250 |
| | 0.7 | 91 | | | |
| | 2 | 69 | | | |
| | 7 | 22 | | | |
| | 20 | 5 | | | |
| | 0.07 | 95 | | | |
| 651900 | 0.2 | 77 | 0.26 | 3' $GalNAc_3$-1 | 2251 |
| | 0.7 | 28 | | | |
| | 2 | 11 | | | |
| | 7 | 8 | | | |
| | 0.07 | 107 | | | |

TABLE 35-continued

ASOs containing GalNAc₃-1 or GalNAc₃-2 targeting SRB-1

| ISIS No. | Dosage (mg/kg) | SRB-1 mRNA levels (% PBS) | ED50 (mg/kg) | Conjugate | SEQ ID No. |
|---|---|---|---|---|---|
| 661134 | 0.2 | 86 | 0.25 | 5' GalNAc₃-2 | 2254 |
|  | 0.7 | 28 |  |  |  |
|  | 2 | 10 |  |  |  |
|  | 7 | 6 |  |  |  |

Structures for 3' GalNAc₃-1 and 5' GalNAc₃-2 were described previously in Examples 9 and 37.

Pharmacokinetics Analysis (PK)

The PK of the ASOs from the high dose group (7 mg/kg) was examined and evaluated in the same manner as illustrated in Example 20. Liver sample was minced and extracted using standard protocols. The full length metabolites of 661134 (5' GalNAc₃-2) and ISIS 651900 (3' GalNAc₃-1) were identified and their masses were confirmed by high resolution mass spectrometry analysis. The results showed that the major metabolite detected for the ASO comprising a phosphodiester linked GalNAc₃-2 conjugate at the 5' terminus (ISIS 661134) was ISIS 440762 (data not shown). No additional metabolites, at a detectable level, were observed. Unlike its counterpart, additional metabolites similar to those reported previously in Table 23a were observed for the ASO having the GalNAc₃-1 conjugate at the 3' terminus (ISIS 651900). These results suggest that having the phosphodiester linked GalNAc₃-1 or GalNAc₃-2 conjugate may improve the PK profile of ASOs without compromising their potency.

Example 44

Effect of PO/PS Linkages on Antisense Inhibition of ASOs Comprising GalNAc₃-1 Conjugate (See Example 9) at the 3' Terminus Targeting SRB-1

ISIS 655861 and 655862 comprising a GalNAc₃-1 conjugate at the 3' terminus each targeting SRB-1 were tested in a single administration study for their ability to inhibit SRB-1 in mice. The parent unconjugated compound, ISIS 353382 was included in the study for comparison.

The ASOs are 5-10-5 MOE gapmers, wherein the gap region comprises ten 2'-deoxyribonucleosides and each wing region comprises five 2'-MOE modified nucleosides. The ASOs were prepared using similar methods as illustrated previously in Example 19 and are described Table 36, below.

TABLE 36

Modified ASOs comprising GalNAc₃-1 conjugate at the 3' terminus targeting SRB-1

| ISIS No. | Sequence (5' to 3') | Chemistry | SEQ ID No. |
|---|---|---|---|
| 353382 (parent) | G$_{es}$$^m$C$_{es}$T$_{es}$T$_{es}$$^m$C$_{es}$ A$_{ds}$G$_{ds}$T$_{ds}$$^m$C$_{ds}$A$_{ds}$ T$_{ds}$G$_{ds}$A$_{ds}$$^m$C$_{ds}$T$_{ds}$ T$_{es}$$^m$C$_{es}$$^m$C$_{es}$T$_{es}$T$_{e}$ | Full PS no conjugate | 2256 |
| 655861 | G$_{es}$$^m$C$_{es}$T$_{es}$T$_{es}$$^m$C$_{es}$ A$_{ds}$G$_{ds}$T$_{ds}$$^m$C$_{ds}$A$_{ds}$ T$_{ds}$G$_{ds}$A$_{ds}$$^m$C$_{ds}$T$_{ds}$ T$_{es}$$^m$C$_{es}$$^m$C$_{es}$T$_{es}$T$_{eo}$ A$_{do'}$-GalNAC₃-1$_a$ | Full PS with GalNAc₃-1 conjugate | 2257 |
| 655862 | G$_{es}$$^m$C$_{eo}$T$_{eo}$T$_{eo}$$^m$C$_{eo}$ A$_{ds}$G$_{ds}$T$_{ds}$$^m$C$_{ds}$A$_{ds}$ T$_{ds}$G$_{ds}$A$_{ds}$$^m$C$_{ds}$T$_{ds}$ T$_{eo}$$^m$C$_{eo}$$^m$C$_{es}$T$_{es}$T$_{eo}$ A$_{do'}$-GalNAC₃-1$_a$ | Mixed PS/PO with GalNAc₃-1 conjugate | 2257 |

Subscripts: "e" indicates 2'-MOE modified nucleoside; "d" indicates β-D-2'-deoxyribonucleoside; "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. The structure of "GalNAc₃-1" is shown in Example 9.

Treatment

Six week old male Balb/c mice (Jackson Laboratory, Bar Harbor, Me.) were injected subcutaneously once at the dosage shown below with ISIS 353382, 655861, 655862 or with PBS treated control. Each treatment group consisted of 4 animals. Prior to the treatment as well as after the last dose, blood was drawn from each mouse and plasma samples were analyzed. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS". The $ED_{50}$s were measured using similar methods as described previously and are reported below.

As illustrated in Table 37, treatment with antisense oligonucleotides lowered SRB-1 mRNA levels in a dose-dependent manner compared to PBS treated control. Indeed, the antisense oligonucleotides comprising the GalNAc₃-1 conjugate at the 3' terminus (ISIS 655861 and 655862) showed substantial improvement in potency comparing to the unconjugated antisense oligonucleotide (ISIS 353382). Further, ISIS 655862 with mixed PS/PO linkages showed an improvement in potency relative to full PS (ISIS 655861).

TABLE 37

Effect of PO/PS linkages on antisense inhibition of ASOs comprising GalNAc₃-1 conjugate at 3' terminus targeting SRB-1

| ISIS No. | Dosage (mg/kg) | SRB-1 mRNA levels (% PBS) | ED50 (mg/kg) | Chemistry | SEQ ID No. |
|---|---|---|---|---|---|
| PBS | 0 | 100 | — | — |  |
| 353382 (parent) | 3 | 76.65 | 10.4 | Full PS without conjugate | 2256 |
|  | 10 | 52.40 |  |  |  |
|  | 30 | 24.95 |  |  |  |
| 655861 | 0.5 | 81.22 | 2.2 | Full PS with GalNAc₃-1 conjugate | 2257 |
|  | 1.5 | 63.51 |  |  |  |
|  | 5 | 24.61 |  |  |  |
|  | 15 | 14.80 |  |  |  |
| 655862 | 0.5 | 69.57 | 1.3 | Mixed PS/PO with GalNAc₃-1 conjugate | 2257 |
|  | 1.5 | 45.78 |  |  |  |
|  | 5 | 19.70 |  |  |  |
|  | 15 | 12.90 |  |  |  |

Liver transaminase levels, alanine aminotransferase (ALT) and aspartate aminotransferase (AST), in serum were measured relative to saline injected mice using standard protocols. Organ weights were also evaluated. The results demonstrated that no elevation in transaminase levels (Table 38) or organ weights (data not shown) were observed in mice treated with ASOs compared to PBS control. Further, the ASO with mixed PS/PO linkages (ISIS 655862) showed similar transaminase levels compared to full PS (ISIS 655861).

TABLE 38

Effect of PO/PS linkages on transaminase levels of ASOs comprising GalNAc$_3$-1 conjugate at 3' terminus targeting SRB-1

| ISIS No. | Dosage (mg/kg) | ALT (U/L) | AST (U/L) | Chemistry | SEQ ID No. |
|---|---|---|---|---|---|
| PBS | 0 | 28.5 | 65 | — | |
| 353382 | 3 | 50.25 | 89 | Full PS without | 2256 |
| (parent) | 10 | 27.5 | 79.3 | conjugate | |
|  | 30 | 27.3 | 97 | | |
| 655861 | 0.5 | 28 | 55.7 | Full PS with | 2257 |
|  | 1.5 | 30 | 78 | GalNAc$_3$-1 | |
|  | 5 | 29 | 63.5 | | |
|  | 15 | 28.8 | 67.8 | | |
| 655862 | 0.5 | 50 | 75.5 | Mixed PS/ | 2257 |
|  | 1.5 | 21.7 | 58.5 | PO with | |
|  | 5 | 29.3 | 69 | GalNAc$_3$-1 | |
|  | 15 | 22 | 61 | | |

Example 45

Preparation of PFP Ester, Compound 110a

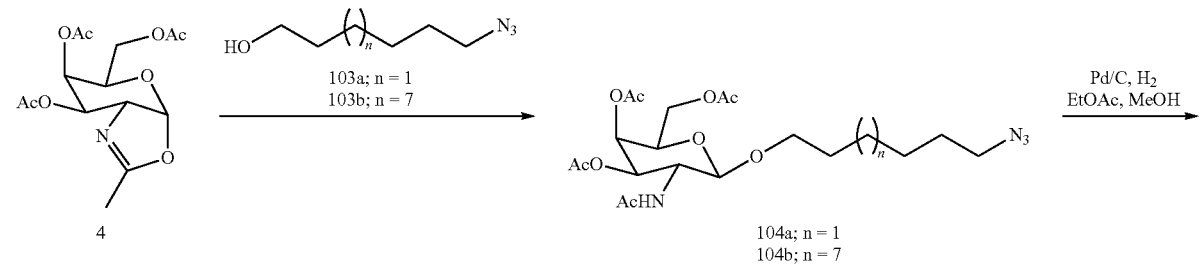

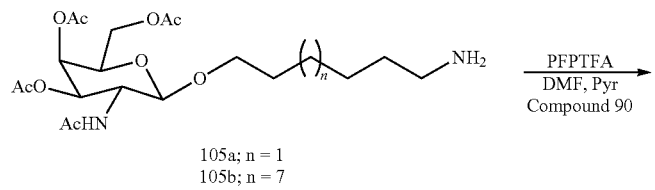

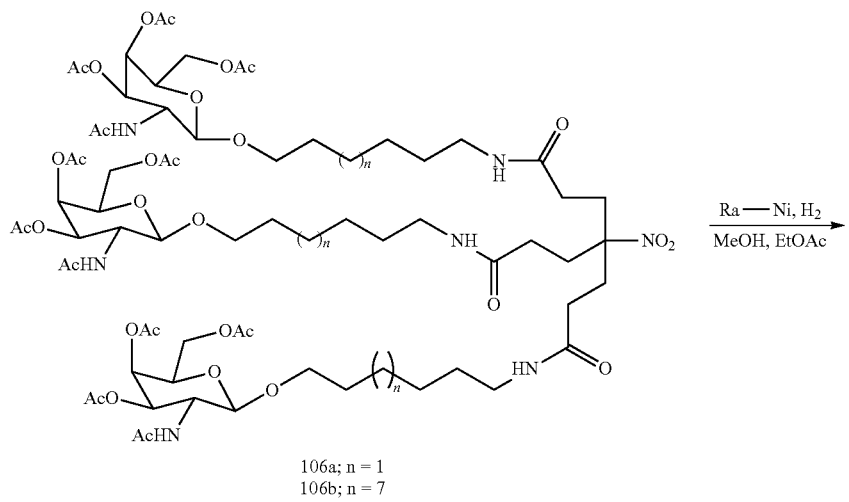

-continued
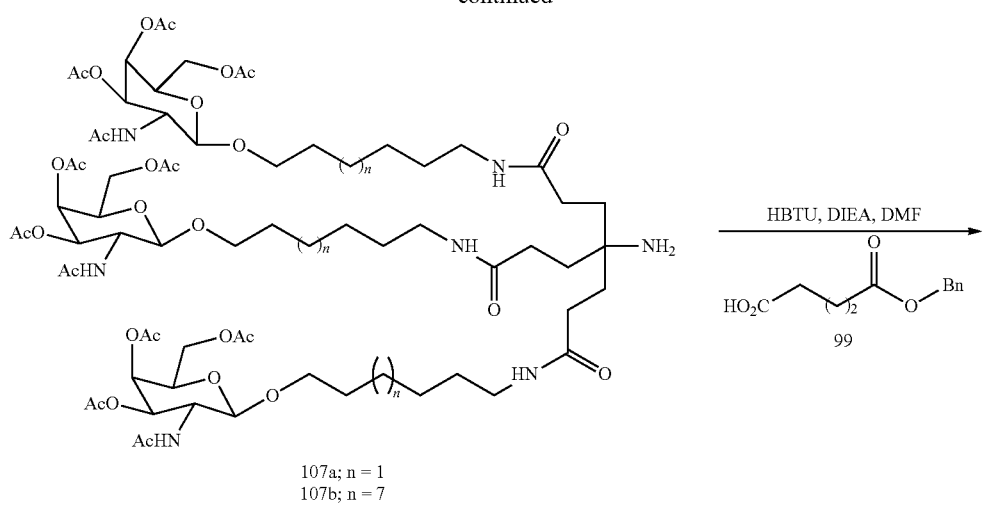
107a; n = 1
107b; n = 7
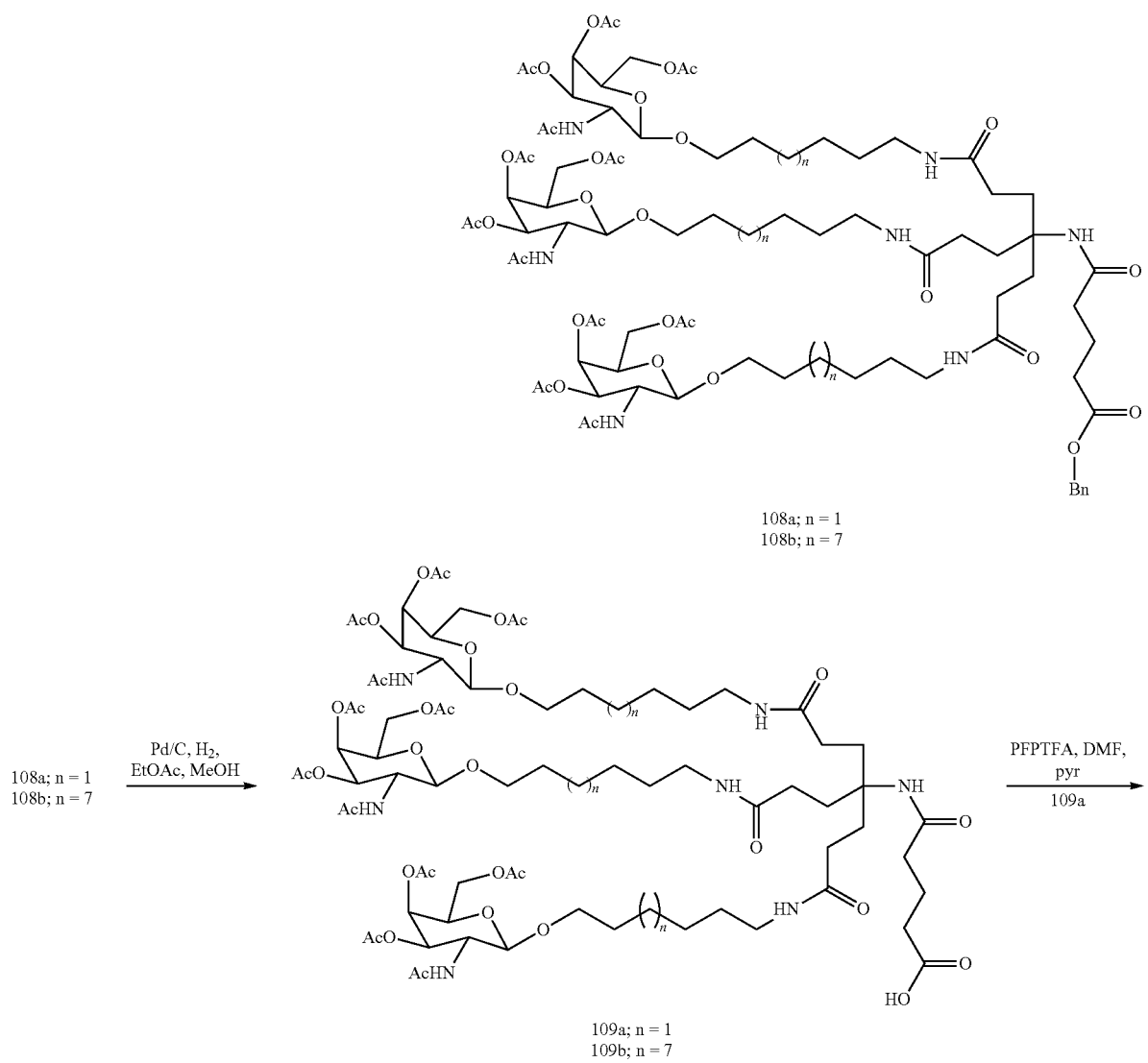
108a; n = 1
108b; n = 7
109a; n = 1
109b; n = 7

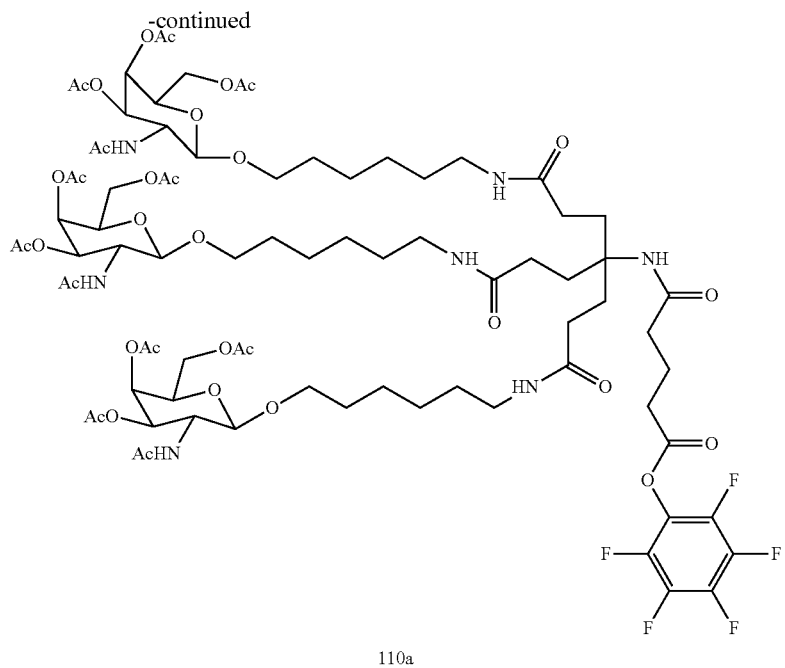

110a

Compound 4 (9.5 g, 28.8 mmoles) was treated with compound 103a or 103b (38 mmoles), individually, and TMSOTf (0.5 eq.) and molecular sieves in dichloromethane (200 mL), and stirred for 16 hours at room temperature. At that time, the organic layer was filtered thru celite, then washed with sodium bicarbonate, water and brine. The organic layer was then separated and dried over sodium sulfate, filtered and reduced under reduced pressure. The resultant oil was purified by silica gel chromatography (2%-->10% methanol/dichloromethane) to give compounds 104a and 104b in >80% yield. LCMS and proton NMR was consistent with the structure.

Compounds 104a and 104b were treated to the same conditions as for compounds 100a-d (Example 47), to give compounds 105a and 105b in >90% yield. LCMS and proton NMR was consistent with the structure.

Compounds 105a and 105b were treated, individually, with compound 90 under the same conditions as for compounds 901a-d, to give compounds 106a (80%) and 106b (20%). LCMS and proton NMR was consistent with the structure.

Compounds 106a and 106b were treated to the same conditions as for compounds 96a-d (Example 47), to give 107a (60%) and 107b (20%). LCMS and proton NMR was consistent with the structure.

Compounds 107a and 107b were treated to the same conditions as for compounds 97a-d (Example 47), to give compounds 108a and 108b in 40-60% yield. LCMS and proton NMR was consistent with the structure.

Compounds 108a (60%) and 108b (40%) were treated to the same conditions as for compounds 100a-d (Example 47), to give compounds 109a and 109b in >80% yields. LCMS and proton NMR was consistent with the structure.

Compound 109a was treated to the same conditions as for compounds 101a-d (Example 47), to give Compound 110a in 30-60% yield. LCMS and proton NMR was consistent with the structure. Alternatively, Compound 110b can be prepared in a similar manner starting with Compound 109b.

Example 46

General Procedure for Conjugation with PFP Esters (Oligonucleotide 111); Preparation of ISIS 666881 (GalNAc$_3$-10)

A 5'-hexylamino modified oligonucleotide was synthesized and purified using standard solid-phase oligonucleotide procedures. The 5'-hexylamino modified oligonucleotide was dissolved in 0.1 M sodium tetraborate, pH 8.5 (200 µL) and 3 equivalents of a selected PFP esterified GalNAc$_3$ cluster dissolved in DMSO (50 µL) was added. If the PFP ester precipitated upon addition to the ASO solution DMSO was added until all PFP ester was in solution. The reaction was complete after about 16 h of mixing at room temperature. The resulting solution was diluted with water to 12 mL and then spun down at 3000 rpm in a spin filter with a mass cut off of 3000 Da. This process was repeated twice to remove small molecule impurities. The solution was then lyophilized to dryness and redissolved in concentrated aqueous ammonia and mixed at room temperature for 2.5 h followed by concentration in vacuo to remove most of the ammonia. The conjugated oligonucleotide was purified and desalted by RP-HPLC and lyophilized to provide the GalNAc$_3$ conjugated oligonucleotide.

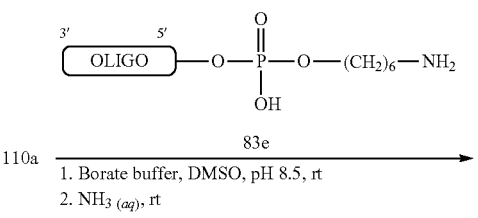

-continued

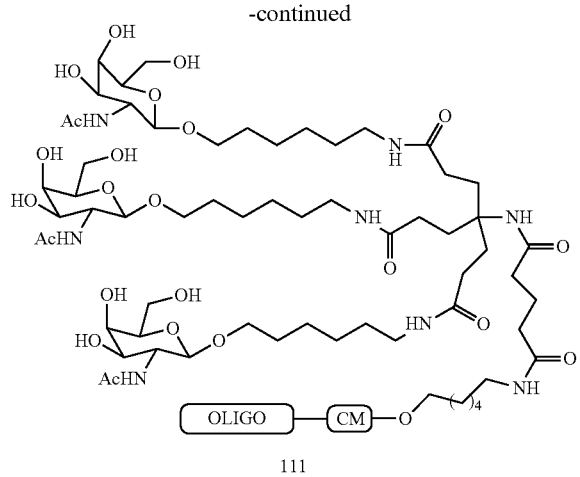

Oligonucleotide 111 is conjugated with GalNAc$_3$-10. The GalNAc$_3$ cluster portion of the conjugate group GalNAc$_3$-10 (GalNAc$_3$-10$_a$) can be combined with any cleavable moiety to provide a variety of conjugate groups. In certain embodiments, the cleavable moiety is —P(=O)(OH)-A$_d$-P(=O)(OH)— as shown in the oligonucleotide (ISIS 666881) synthesized with GalNAc$_3$-10 below. The structure of GalNAc$_3$-10 (GalNAc$_3$-10$_a$-CM-) is shown below:

a mass cut off of 3000 Da. This process was repeated twice to remove small molecule impurities. The solution was lyophilized to dryness and redissolved in concentrated aqueous ammonia with mixing at room temperature for 2.5 h followed by concentration in vacuo to remove most of the ammonia. The conjugated oligonucleotide was purified and desalted by RP-HPLC and lyophilized to give ISIS 666881 in 90% yield by weight (42 mg, 4.7 μmol).

| GalNAc$_3$-10 conjugated oligonucleotide ||||
| ASO | Sequence (5' to 3') | 5' group | SEQ ID No. |
| --- | --- | --- | --- |
| ISIS 660254 | NH$_2$(CH$_2$)$_{6-o}$A$_{do}$G$_{es}$ $^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$ T$_{es}$T$_e$ | Hexylamine | 2258 |
| ISIS 666881 | GalNAc$_3$-10$_{a-o}$,A$_{do}$ G$_{es}$$^m$C$_{es}$T$_{es}$T$_{es}$$^m$C$_{es}$A$_{ds}$ G$_{ds}$T$_{ds}$$^m$C$_{ds}$A$_{ds}$T$_{ds}$G$_{ds}$ A$_{ds}$$^m$C$_{ds}$T$_{ds}$T$_{es}$$^m$C$_{es}$ $^m$C$_{es}$T$_{es}$T$_e$ | GalNAc$_3$-10 | 2258 |

Capital letters indicate the nucleobase for each nucleoside and $^m$C indicates a 5-methyl cytosine. Subscripts: "e" indicates a 2'-MOE modified nucleoside; "d" indicates a β-D-

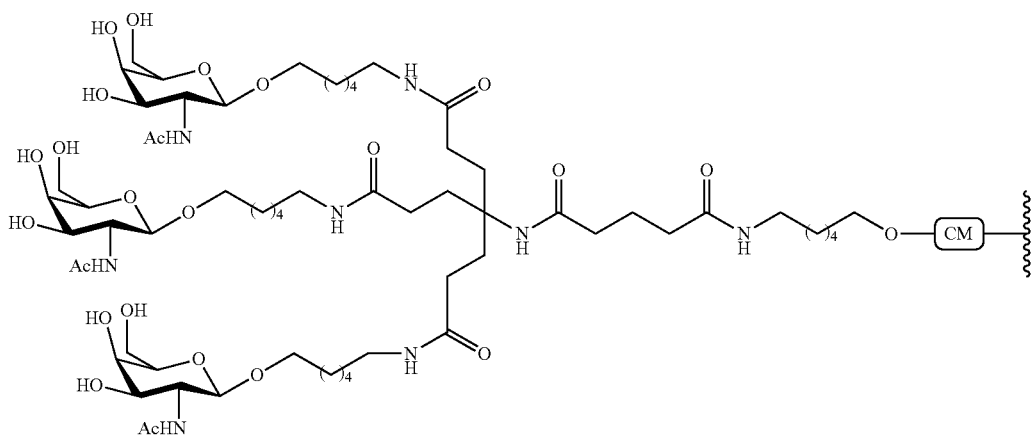

Following this general procedure ISIS 666881 was prepared. 5'-hexylamino modified oligonucleotide, ISIS 660254, was synthesized and purified using standard solid-phase oligonucleotide procedures. ISIS 660254 (40 mg, 5.2 μmol) was dissolved in 0.1 M sodium tetraborate, pH 8.5 (200 μL) and 3 equivalents PFP ester (Compound 110a) dissolved in DMSO (50 μL) was added. The PFP ester precipitated upon addition to the ASO solution requiring additional DMSO (600 μL) to fully dissolve the PFP ester. The reaction was complete after 16 h of mixing at room temperature. The solution was diluted with water to 12 mL total volume and spun down at 3000 rpm in a spin filter with 2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

Example 47

Preparation of Oligonucleotide 102 Comprising GalNAc$_3$-8

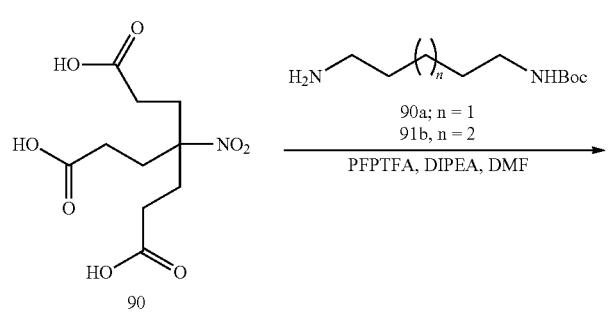
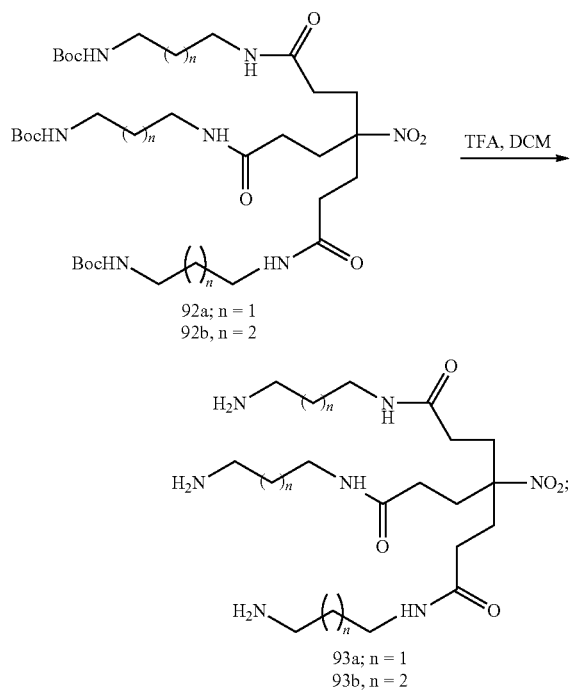
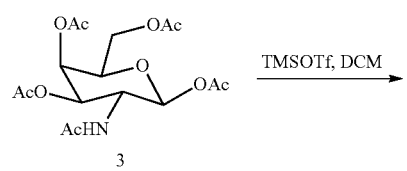
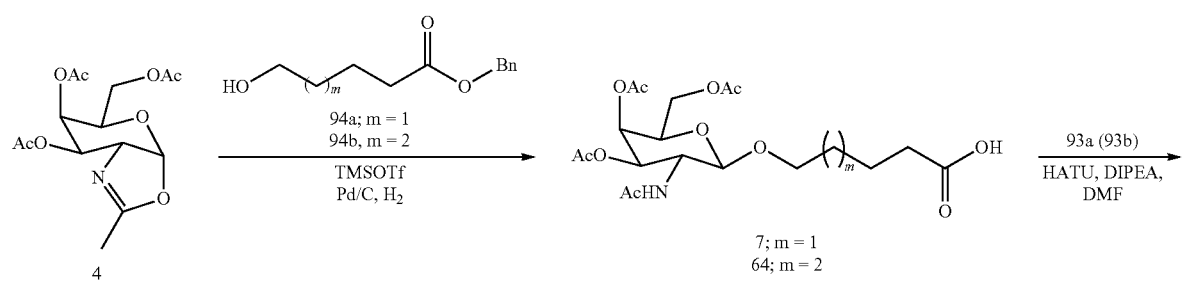
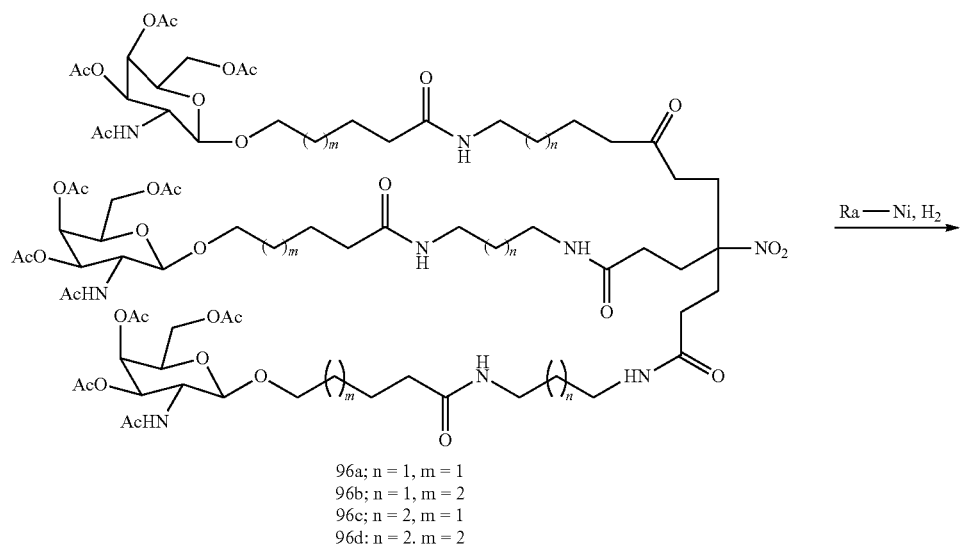

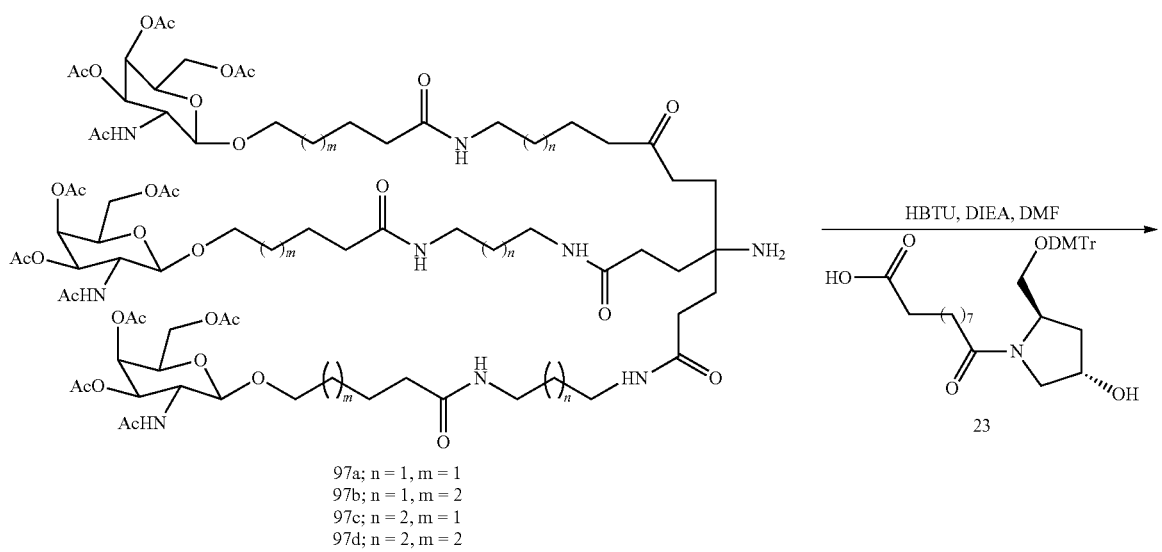
97a; n = 1, m = 1
97b; n = 1, m = 2
97c; n = 2, m = 1
97d; n = 2, m = 2
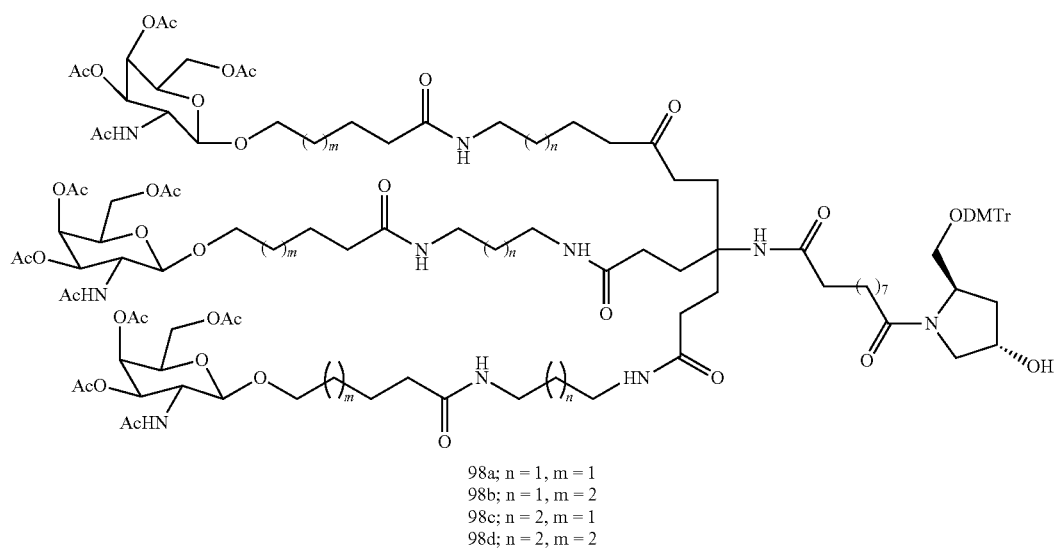
98a; n = 1, m = 1
98b; n = 1, m = 2
98c; n = 2, m = 1
98d; n = 2, m = 2
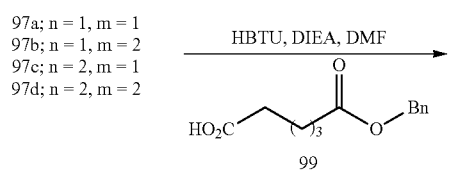
97a; n = 1, m = 1
97b; n = 1, m = 2
97c; n = 2, m = 1
97d; n = 2, m = 2

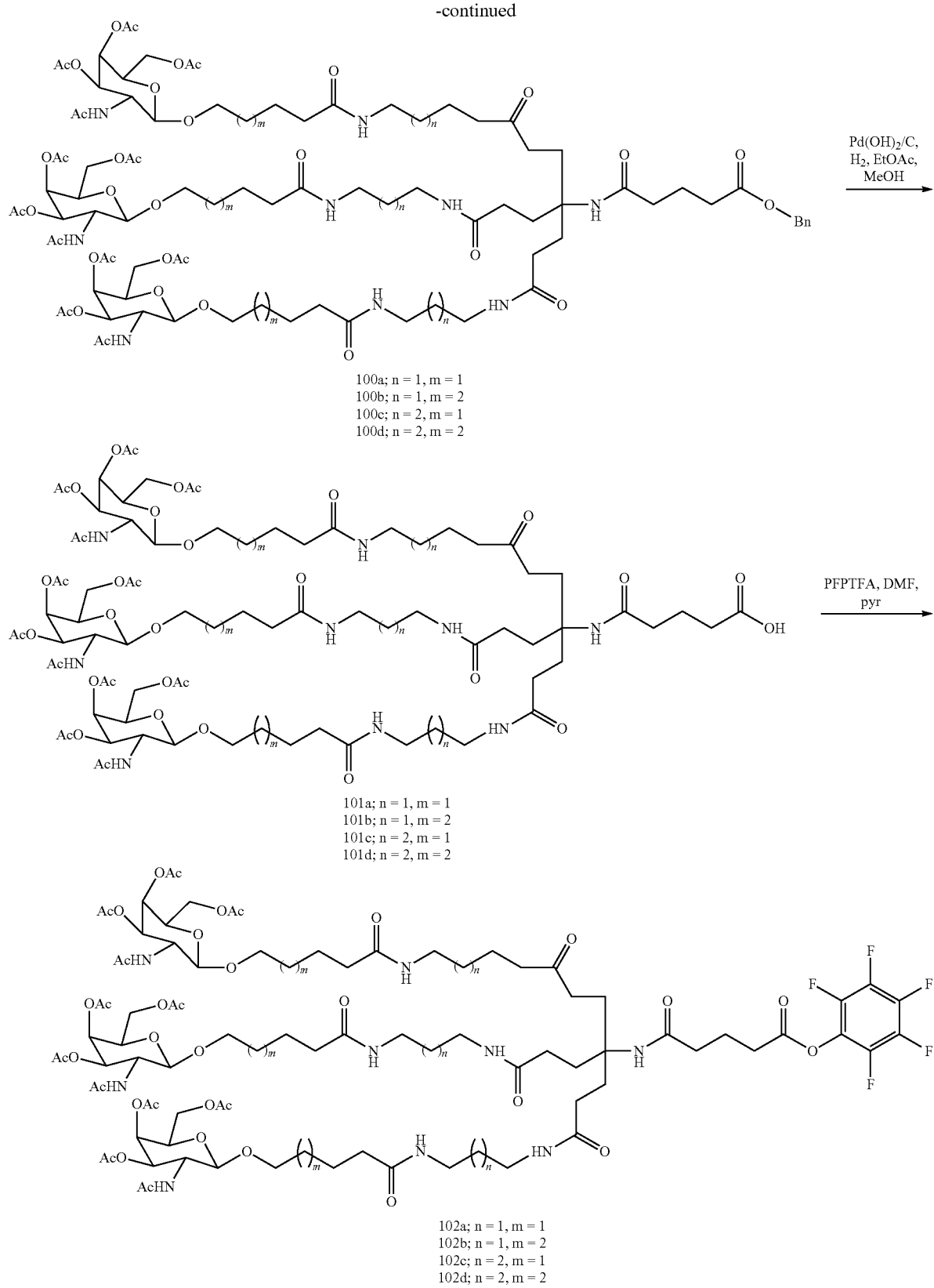
100a; n = 1, m = 1
100b; n = 1, m = 2
100c; n = 2, m = 1
100d; n = 2, m = 2
101a; n = 1, m = 1
101b; n = 1, m = 2
101c; n = 2, m = 1
101d; n = 2, m = 2
102a; n = 1, m = 1
102b; n = 1, m = 2
102c; n = 2, m = 1
102d; n = 2, m = 2
The triacid 90 (4 g, 14.43 mmol) was dissolved in DMF (120 mL) and N,N-Diisopropylethylamine (12.35 mL, 72 mmoles). Pentafluorophenyl trifluoroacetate (8.9 mL, 52 mmoles) was added dropwise, under argon, and the reaction was allowed to stir at room temperature for 30 minutes. Boc-diamine 91a or 91b (68.87 mmol) was added, along with N,N-Diisopropylethylamine (12.35 mL, 72 mmoles), and the reaction was allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%-->10% methanol/dichloromethane) to give compounds 92a and 92b in an approximate 80% yield. LCMS and proton NMR were consistent with the structure.

Compound 92a or 92b (6.7 mmoles) was treated with 20 mL of dichloromethane and 20 mL of trifluoroacetic acid at room temperature for 16 hours. The resultant solution was evaporated and then dissolved in methanol and treated with DOWEX-OH resin for 30 minutes. The resultant solution was filtered and reduced to an oil under reduced pressure to give 85-90% yield of compounds 93a and 93b.

Compounds 7 or 64 (9.6 mmoles) were treated with HBTU (3.7 g, 9.6 mmoles) and N,N-Diisopropylethylamine (5 mL) in DMF (20 mL) for 15 minutes. To this was added either compounds 93a or 93b (3 mmoles), and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (5%-->20% methanol/dichloromethane) to give compounds 96a-d in 20-40% yield. LCMS and proton NMR was consistent with the structure.

Compounds 96a-d (0.75 mmoles), individually, were hydrogenated over Raney Nickel for 3 hours in Ethanol (75 mL). At that time, the catalyst was removed by filtration thru celite, and the ethanol removed under reduced pressure to give compounds 97a-d in 80-90% yield. LCMS and proton NMR were consistent with the structure.

Compound 23 (0.32 g, 0.53 mmoles) was treated with HBTU (0.2 g, 0.53 mmoles) and N,N-Diisopropylethylamine (0.19 mL, 1.14 mmoles) in DMF (30 mL) for 15 minutes. To this was added compounds 97a-d (0.38 mmoles), individually, and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%-->20% methanol/dichloromethane) to give compounds 98a-d in 30-40% yield. LCMS and proton NMR was consistent with the structure.

Compound 99 (0.17 g, 0.76 mmoles) was treated with HBTU (0.29 g, 0.76 mmoles) and N,N-Diisopropylethylamine (0.35 mL, 2.0 mmoles) in DMF (50 mL) for 15 minutes. To this was added compounds 97a-d (0.51 mmoles), individually, and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (5%-->20% methanol/dichloromethane) to give compounds 100a-d in 40-60% yield. LCMS and proton NMR was consistent with the structure.

Compounds 100a-d (0.16 mmoles), individually, were hydrogenated over 10% Pd(OH)$_2$/C for 3 hours in methanol/ethyl acetate (1:1, 50 mL). At that time, the catalyst was removed by filtration thru celite, and the organics removed under reduced pressure to give compounds 101a-d in 80-90% yield. LCMS and proton NMR was consistent with the structure.

Compounds 101a-d (0.15 mmoles), individually, were dissolved in DMF (15 mL) and pyridine (0.016 mL, 0.2 mmoles). Pentafluorophenyl trifluoroacetate (0.034 mL, 0.2 mmoles) was added dropwise, under argon, and the reaction was allowed to stir at room temperature for 30 minutes. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%-->5% methanol/dichloromethane) to give compounds 102a-d in an approximate 80% yield. LCMS and proton NMR were consistent with the structure.

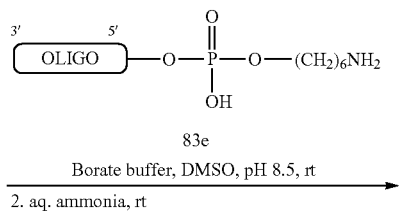

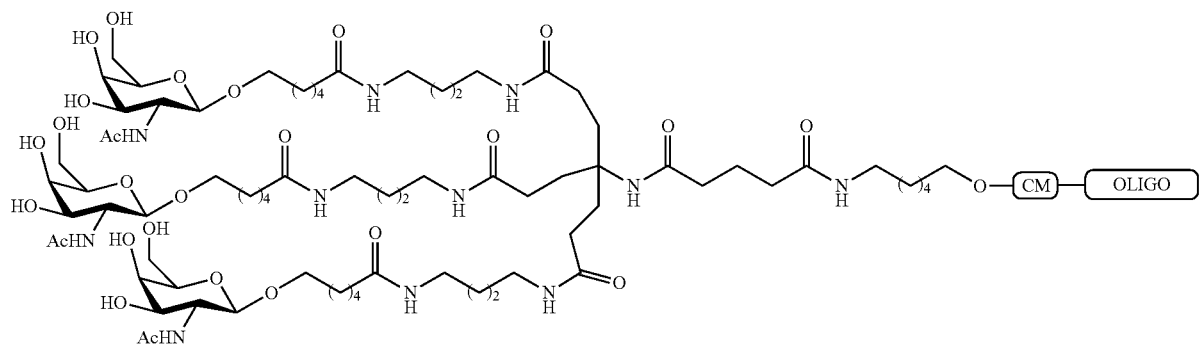

102

Oligomeric Compound 102, comprising a GalNAc$_3$-8 conjugate group, was prepared using the general procedures illustrated in Example 46. The GalNAc$_3$ cluster portion of the conjugate group GalNAc$_3$-8 (GalNAc$_3$-8$_a$) can be combined with any cleavable moiety to provide a variety of conjugate groups. In a preferred embodiment, the cleavable moiety is —P(=O)(OH)-A$_d$-P(=O)(OH)—.

The structure of GalNAc$_3$-8 (GalNAc$_3$-8$_a$-CM-) is shown below:

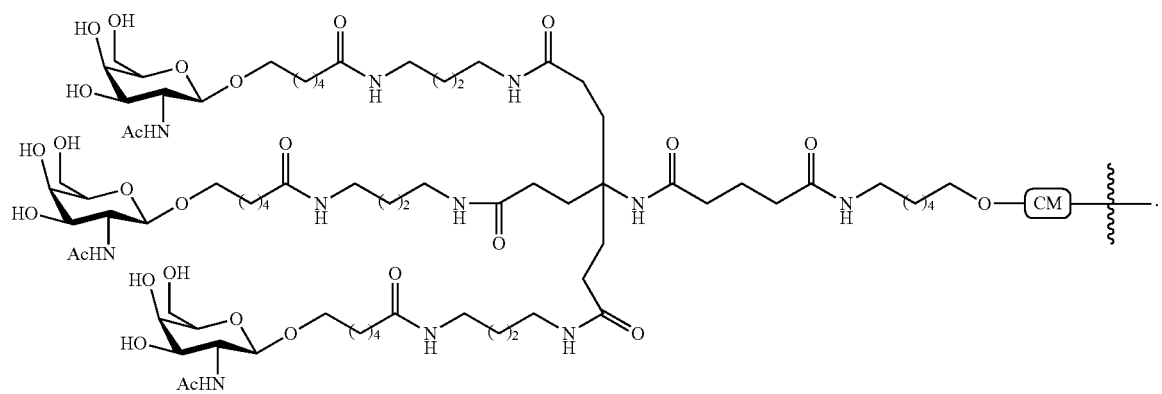

Example 48

Preparation of Oligonucleotide 119 Comprising GalNAc$_3$-7

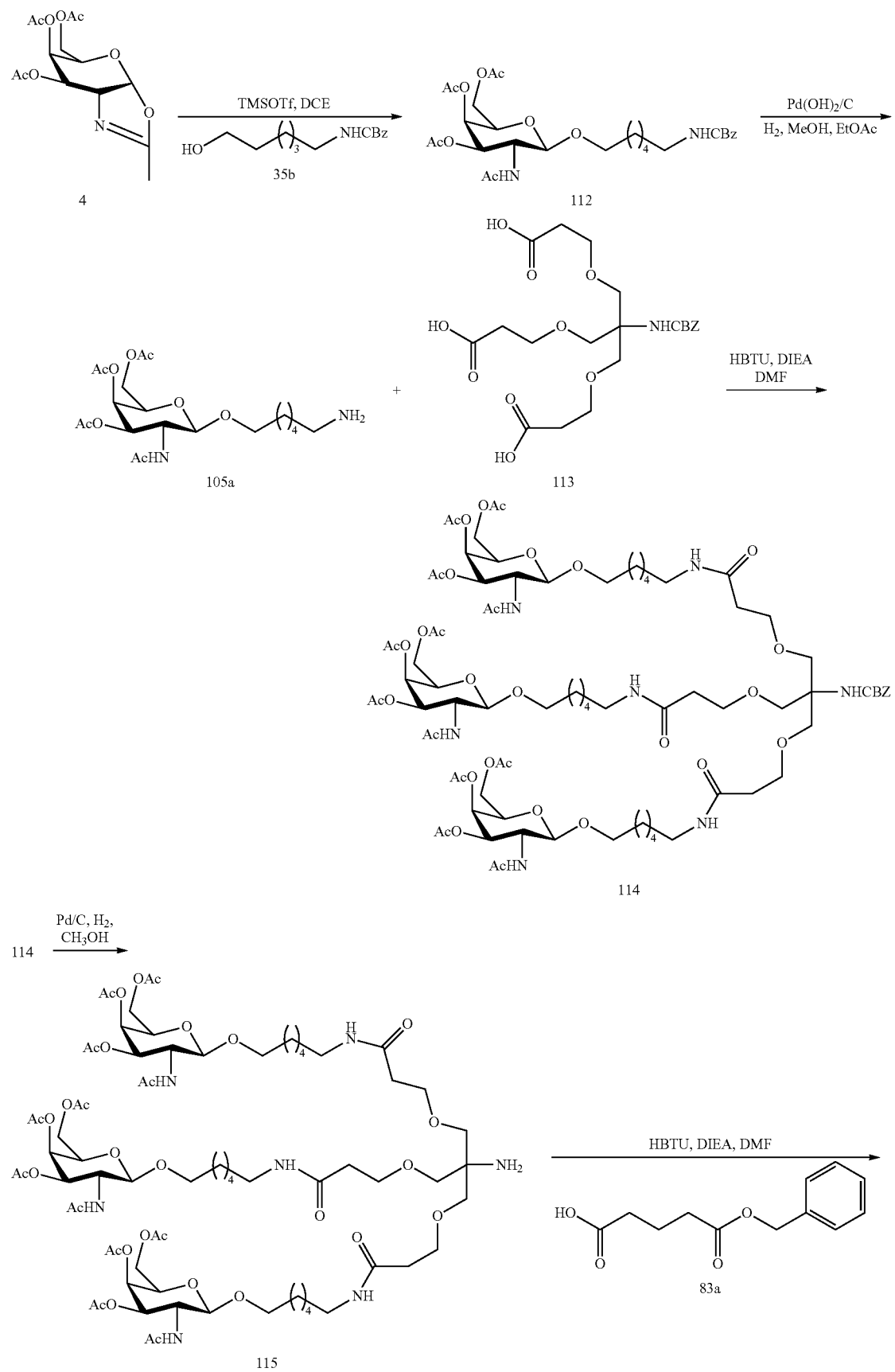

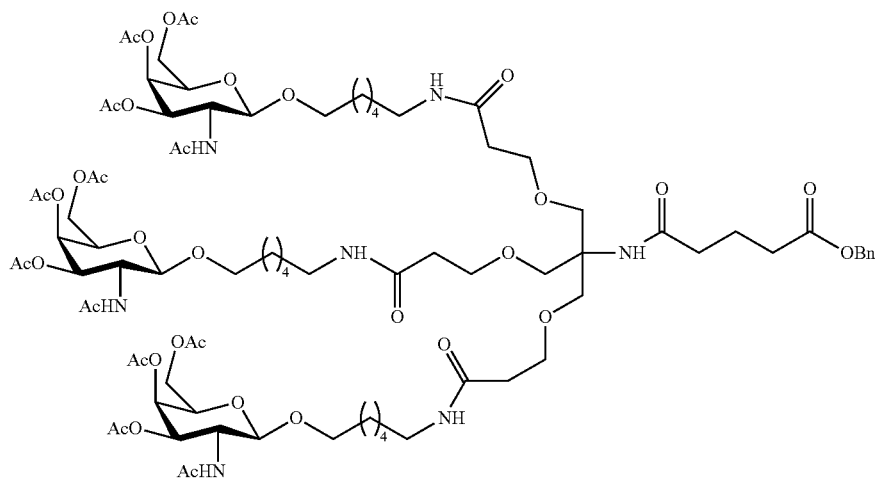

116

Compound 112 was synthesized following the procedure described in the literature (*J. Med. Chem.* 2004, 47, 5798-5808).

Compound 112 (5 g, 8.6 mmol) was dissolved in 1:1 methanol/ethyl acetate (22 mL/22 mL). Palladium hydroxide on carbon (0.5 g) was added. The reaction mixture was stirred at room temperature under hydrogen for 12 h. The reaction mixture was filtered through a pad of celite and washed the pad with 1:1 methanol/ethyl acetate. The filtrate and the washings were combined and concentrated to dryness to yield Compound 105a (quantitative). The structure was confirmed by LCMS.

Compound 113 (1.25 g, 2.7 mmol), HBTU (3.2 g, 8.4 mmol) and DIEA (2.8 mL, 16.2 mmol) were dissolved in anhydrous DMF (17 mL) and the reaction mixture was stirred at room temperature for 5 min. To this a solution of Compound 105a (3.77 g, 8.4 mmol) in anhydrous DMF (20 mL) was added. The reaction was stirred at room temperature for 6 h. Solvent was removed under reduced pressure to get an oil. The residue was dissolved in CH$_2$Cl$_2$ (100 mL) and washed with aqueous saturated NaHCO$_3$ solution (100 mL) and brine (100 mL). The organic phase was separated, dried (Na$_2$SO$_4$), filtered and evaporated. The residue was purified by silica gel column chromatography and eluted with 10 to 20% MeOH in dichloromethane to yield Compound 114 (1.45 g, 30%). The structure was confirmed by LCMS and $^1$H NMR analysis.

Compound 114 (1.43 g, 0.8 mmol) was dissolved in 1:1 methanol/ethyl acetate (4 mL/4 mL). Palladium on carbon (wet, 0.14 g) was added. The reaction mixture was flushed with hydrogen and stirred at room temperature under hydrogen for 12 h. The reaction mixture was filtered through a pad of celite. The celite pad was washed with methanol/ethyl acetate (1:1). The filtrate and the washings were combined together and evaporated under reduced pressure to yield Compound 115 (quantitative). The structure was confirmed by LCMS and $^1$H NMR analysis.

Compound 83a (0.17 g, 0.75 mmol), HBTU (0.31 g, 0.83 mmol) and DIEA (0.26 mL, 1.5 mmol) were dissolved in anhydrous DMF (5 mL) and the reaction mixture was stirred at room temperature for 5 min. To this a solution of Compound 115 (1.22 g, 0.75 mmol) in anhydrous DMF was added and the reaction was stirred at room temperature for 6 h. The solvent was removed under reduced pressure and the residue was dissolved in CH$_2$Cl$_2$. The organic layer was washed aqueous saturated NaHCO$_3$ solution and brine and dried over anhydrous Na$_2$SO$_4$ and filtered. The organic layer was concentrated to dryness and the residue obtained was purified by silica gel column chromatography and eluted with 3 to 15% MeOH in dichloromethane to yield Compound 116 (0.84 g, 61%). The structure was confirmed by LC MS and $^1$H NMR analysis.

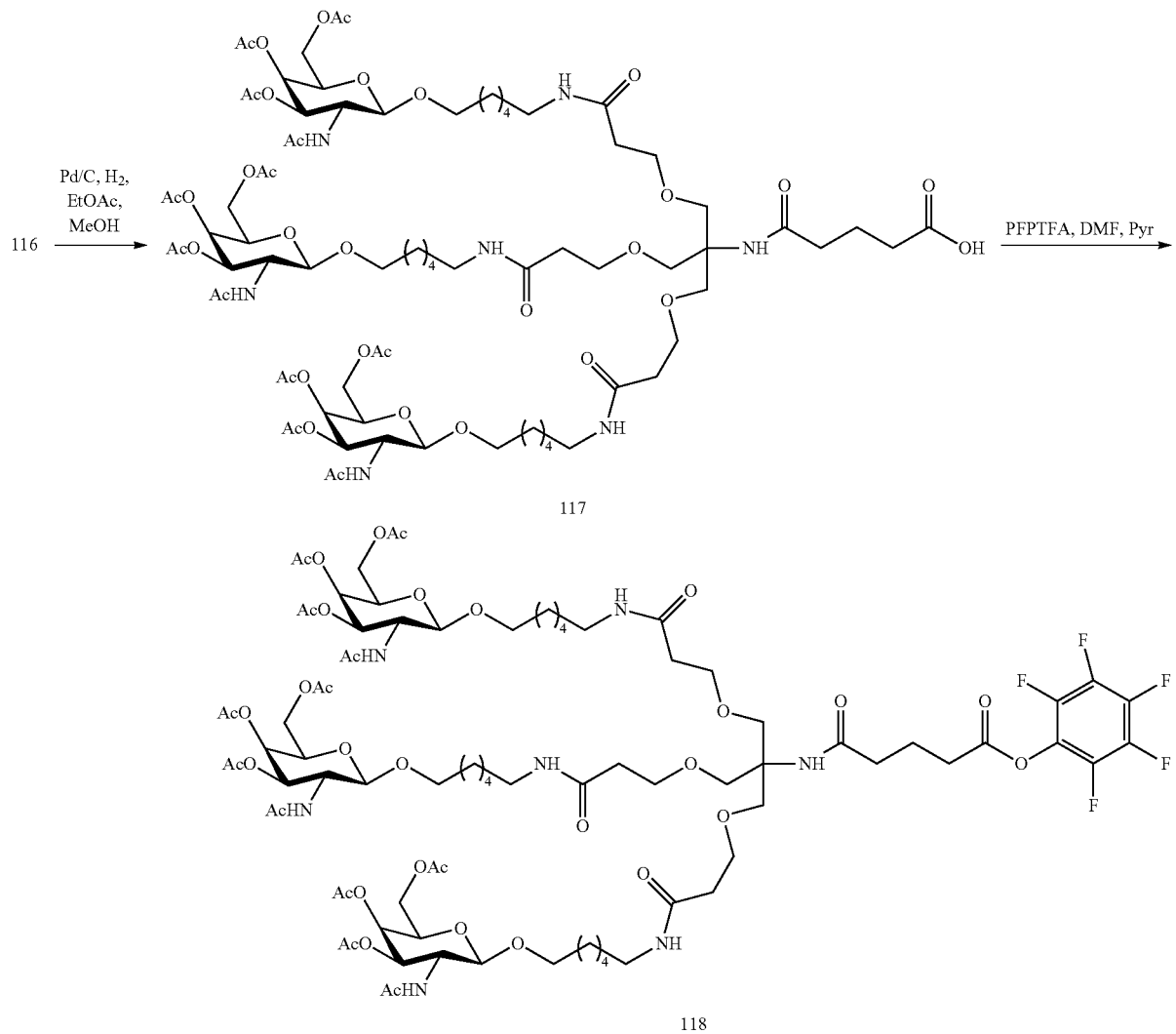

Compound 116 (0.74 g, 0.4 mmol) was dissolved in 1:1 methanol/ethyl acetate (5 mL/5 mL). Palladium on carbon (wet, 0.074 g) was added. The reaction mixture was flushed with hydrogen and stirred at room temperature under hydrogen for 12 h. The reaction mixture was filtered through a pad of celite. The celite pad was washed with methanol/ethyl acetate (1:1). The filtrate and the washings were combined together and evaporated under reduced pressure to yield compound 117 (0.73 g, 98%). The structure was confirmed by LCMS and $^1$H NMR analysis.

Compound 117 (0.63 g, 0.36 mmol) was dissolved in anhydrous DMF (3 mL). To this solution N,N-Diisopropylethylamine (70 µL, 0.4 mmol) and pentafluorophenyl trifluoroacetate (72 µL, 0.42 mmol) were added. The reaction mixture was stirred at room temperature for 12 h and poured into a aqueous saturated NaHCO$_3$ solution. The mixture was extracted with dichloromethane, washed with brine and dried over anhydrous Na$_2$SO$_4$. The dichloromethane solution was concentrated to dryness and purified with silica gel column chromatography and eluted with 5 to 10% MeOH in dichloromethane to yield compound 118 (0.51 g, 79%). The structure was confirmed by LCMS and $^1$H and $^1$H and $^{19}$F NMR.

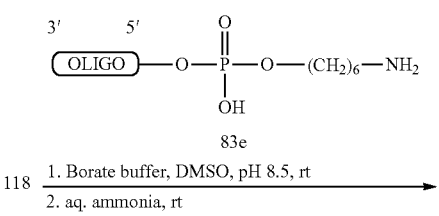

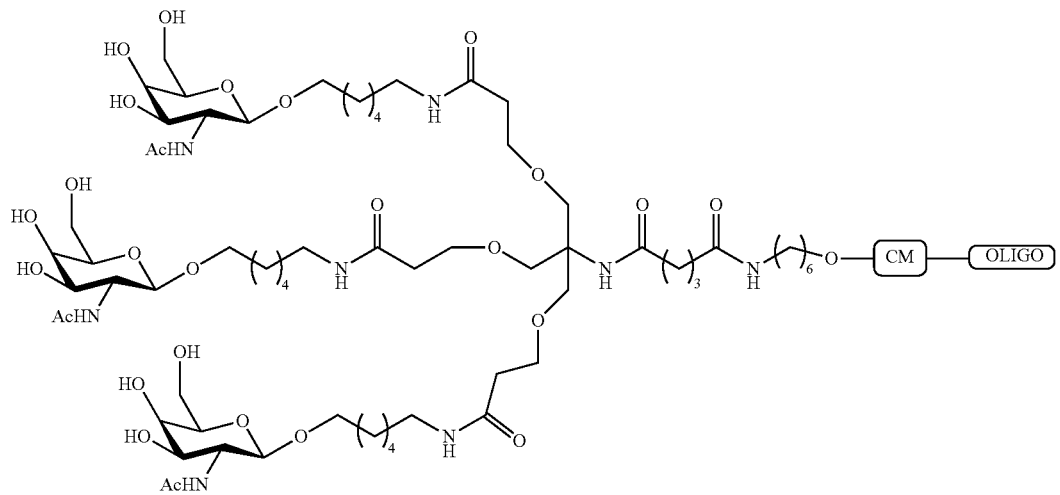

119

Oligomeric Compound 119, comprising a GalNAc$_3$-7 conjugate group, was prepared using the general procedures illustrated in Example 46. The GalNAc$_3$ cluster portion of the conjugate group GalNAc$_3$-7 (GalNAc$_3$-7$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-7 (GalNAc$_3$-7$_a$-CM-) is shown below:

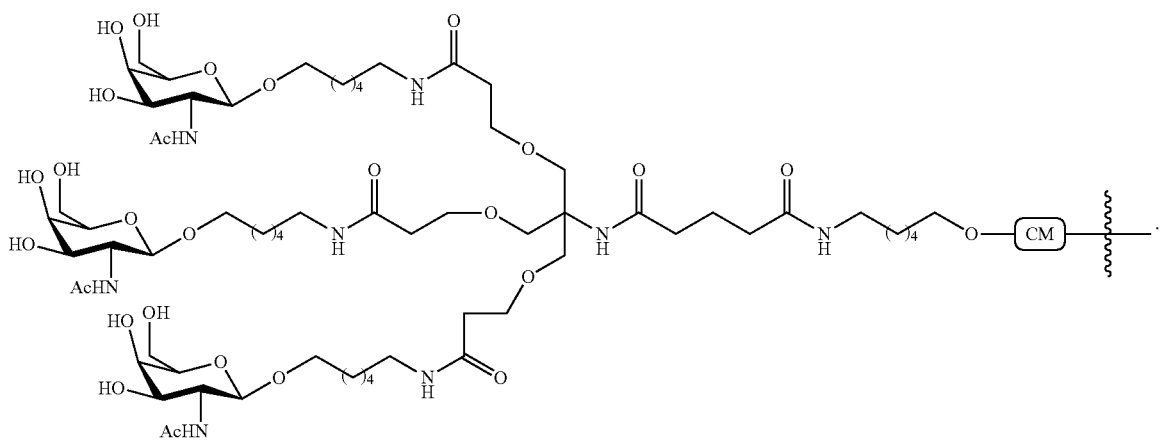

Example 49

Preparation of Oligonucleotide 132 Comprising GalNAc₃-5

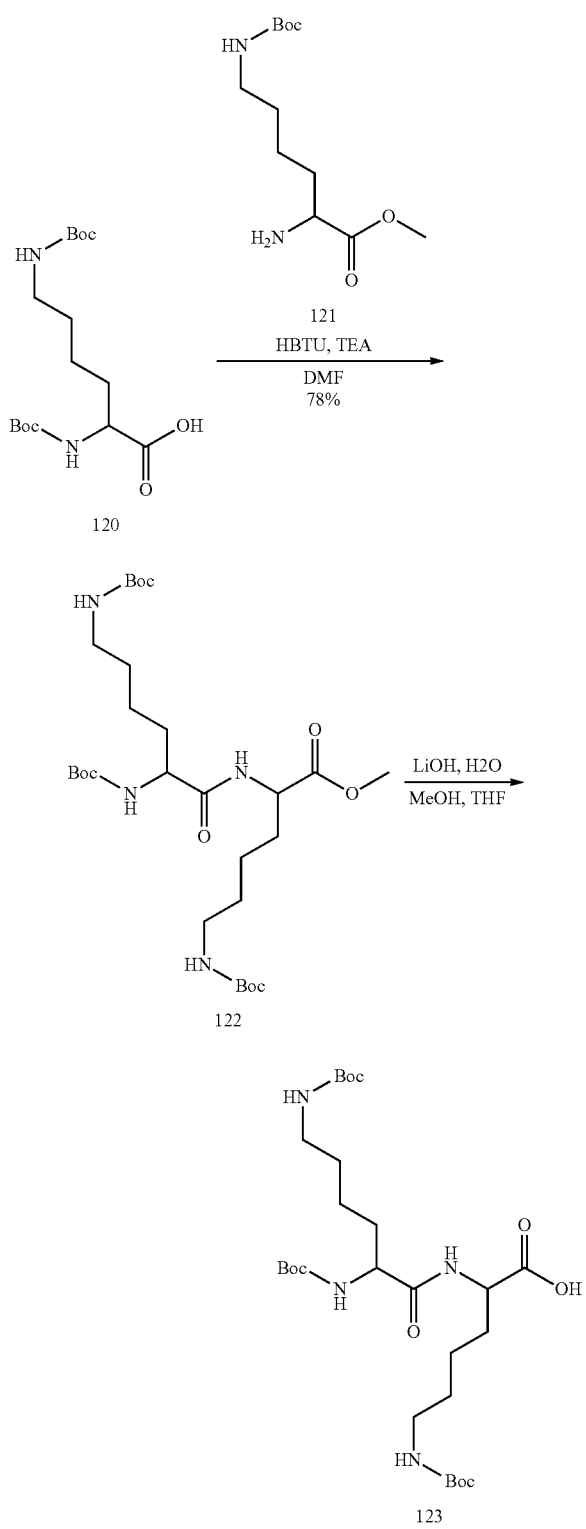 [SMILES: CC(C)(C)OC(=O)NCCCCC(NC(=O)OC(C)(C)C)C(=O)O ; COC(=O)C(N)CCCCNC(=O)OC(C)(C)C ; "DMF78%" ; COC(=O)C(CCCCNC(=O)OC(C)(C)C)NC(=O)C(CCCCNC(=O)OC(C)(C)C)NC(=O)OC(C)(C)C ; CC(C)(C)OC(=O)NCCCCC(NC(=O)C(CCCCNC(=O)OC(C)(C)C)NC(=O)OC(C)(C)C)C(=O)O]

Compound 120 (14.01 g, 40 mmol) and HBTU (14.06 g, 37 mmol) were dissolved in anhydrous DMF (80 mL). Triethylamine (11.2 mL, 80.35 mmol) was added and stirred for 5 min. The reaction mixture was cooled in an ice bath and a solution of compound 121 (10 g, mmol) in anhydrous DMF (20 mL) was added. Additional triethylamine (4.5 mL, 32.28 mmol) was added and the reaction mixture was stirred for 18 h under an argon atmosphere. The reaction was monitored by TLC (ethyl acetate:hexane; 1:1; Rf=0.47). The solvent was removed under reduced pressure. The residue was taken up in EtOAc (300 mL) and washed with 1M NaHSO₄ (3×150 mL), aqueous saturated NaHCO₃ solution (3×150 mL) and brine (2×100 mL). Organic layer was dried with Na₂SO₄. Drying agent was removed by filtration and organic layer was concentrated by rotary evaporation. Crude mixture was purified by silica gel column chromatography and eluted by using 35-50% EtOAc in hexane to yield a compound 122 (15.50 g, 78.13%). The structure was confirmed by LCMS and $^1$H NMR analysis. Mass m/z 589.3 [M+H]⁺.

A solution of LiOH (92.15 mmol) in water (20 mL) and THF (10 mL) was added to a cooled solution of Compound 122 (7.75 g, 13.16 mmol) dissolved in methanol (15 mL). The reaction mixture was stirred at room temperature for 45 min. and monitored by TLC (EtOAc:hexane; 1:1). The reaction mixture was concentrated to half the volume under reduced pressure. The remaining solution was cooled an ice bath and neutralized by adding concentrated HCl. The reaction mixture was diluted, extracted with EtOAc (120 mL) and washed with brine (100 mL). An emulsion formed and cleared upon standing overnight. The organic layer was separated dried (Na₂SO₄), filtered and evaporated to yield Compound 123 (8.42 g). Residual salt is the likely cause of excess mass. LCMS is consistent with structure. Product was used without any further purification. M.W.cal: 574.36; M.W.fd: 575.3 [M+H]⁺.

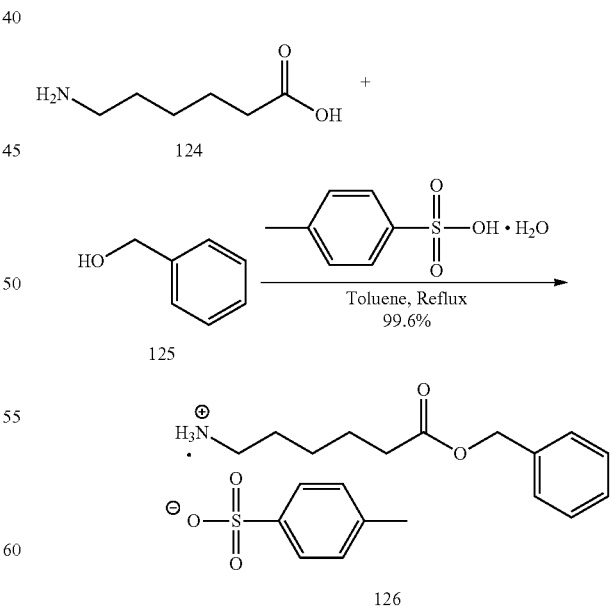

Compound 126 was synthesized following the procedure described in the literature (*J. Am. Chem. Soc.* 2011, 133, 958-963).

289 290
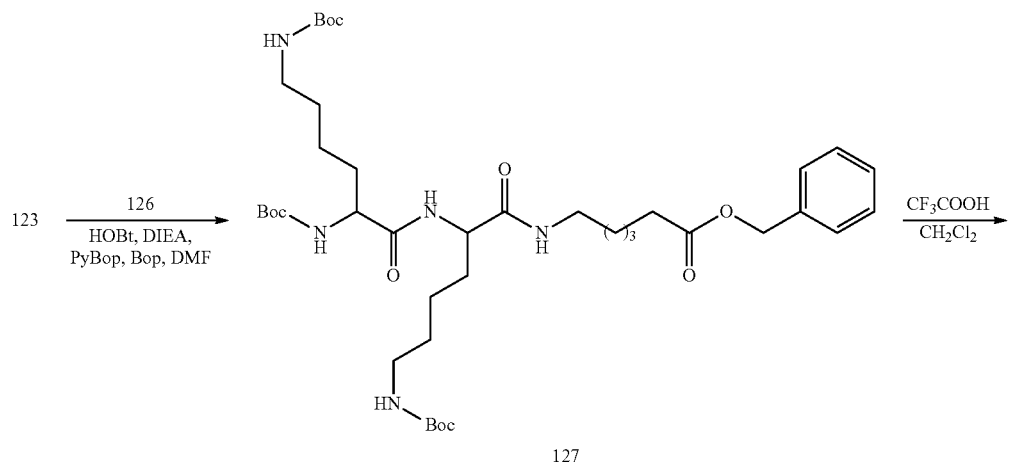
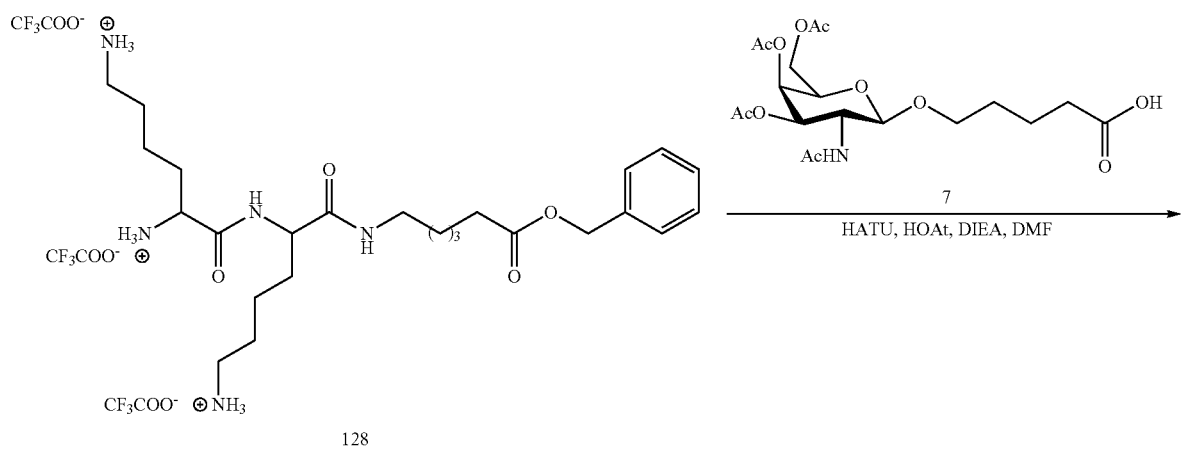
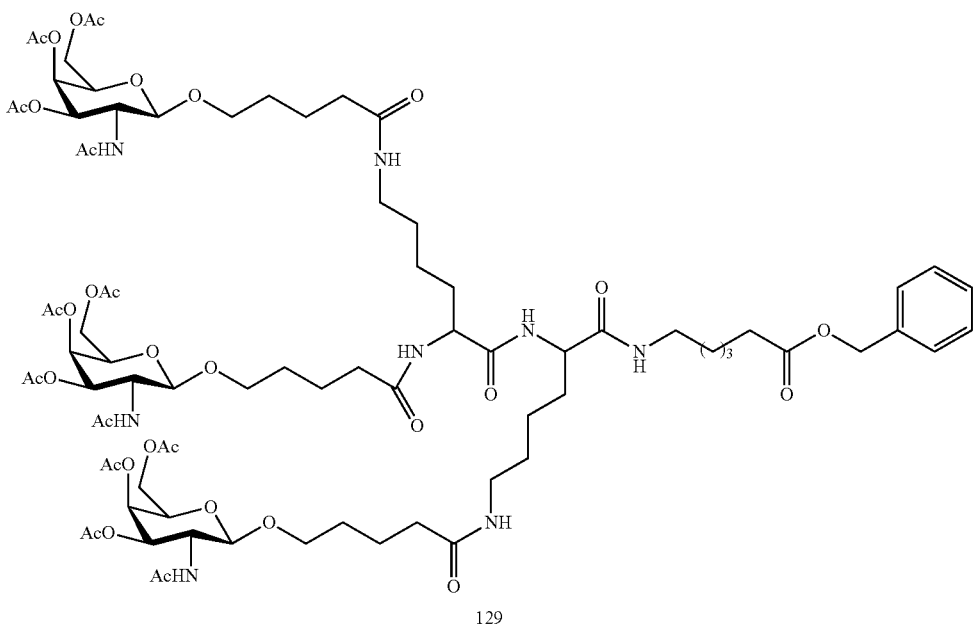

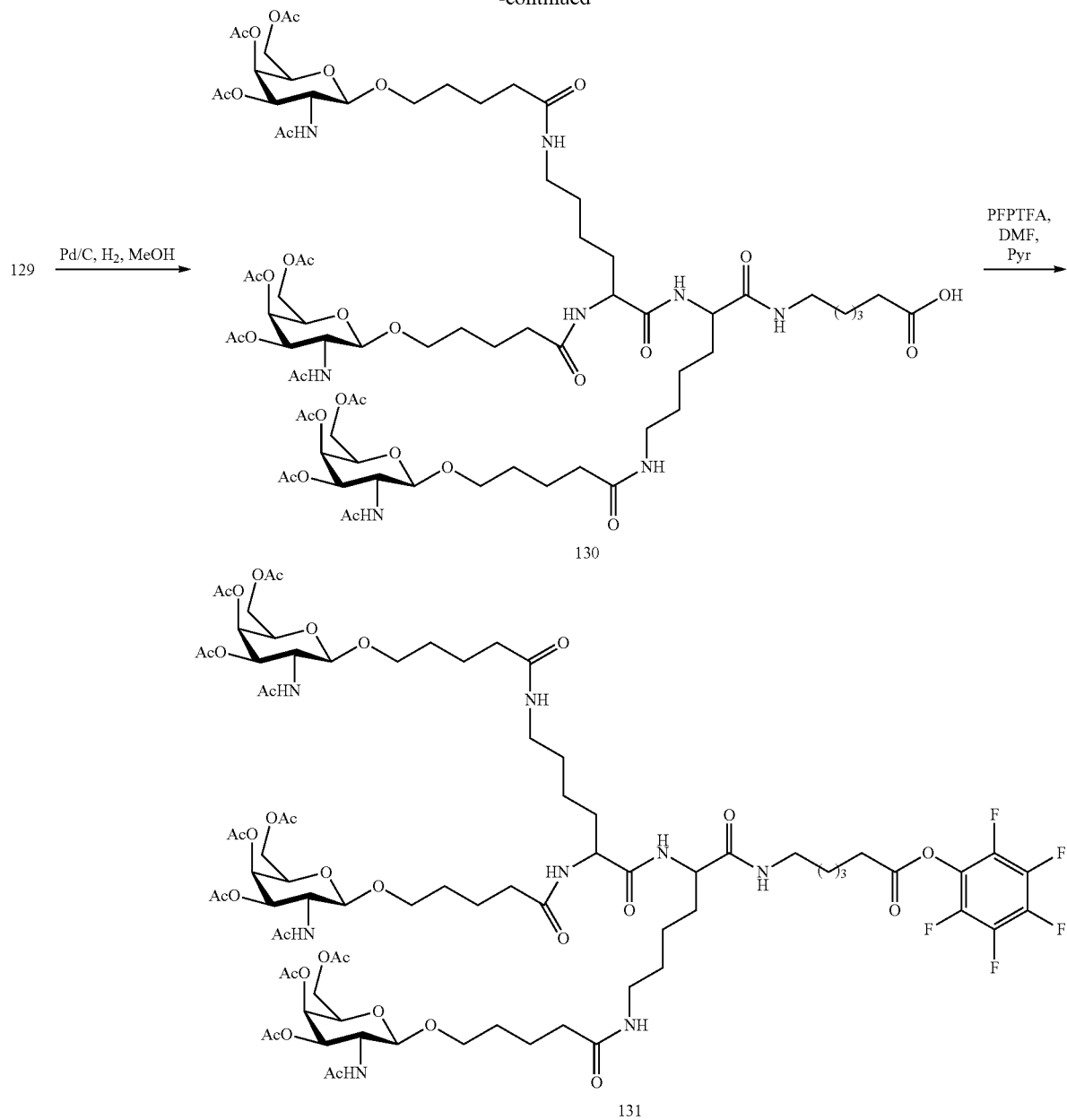

Compound 123 (7.419 g, 12.91 mmol), HOBt (3.49 g, 25.82 mmol) and compound 126 (6.33 g, 16.14 mmol) were dissolved in and DMF (40 mL) and the resulting reaction mixture was cooled in an ice bath. To this N,N-Diisopropylethylamine (4.42 mL, 25.82 mmol), PyBop (8.7 g, 16.7 mmol) followed by Bop coupling reagent (1.17 g, 2.66 mmol) were added under an argon atmosphere. The ice bath was removed and the solution was allowed to warm to room temperature. The reaction was completed after 1 h as determined by TLC (DCM:MeOH:AA; 89:10:1). The reaction mixture was concentrated under reduced pressure. The residue was dissolved in EtOAc (200 mL) and washed with 1 M NaHSO$_4$ (3×100 mL), aqueous saturated NaHCO$_3$ (3×100 mL) and brine (2×100 mL). The organic phase separated dried (Na$_2$SO$_4$), filtered and concentrated. The residue was purified by silica gel column chromatography with a gradient of 50% hexanes/EtOAC to 100% EtOAc to yield Compound 127 (9.4 g) as a white foam. LCMS and $^1$H NMR were consistent with structure. Mass m/z 778.4 [M+H]$^+$.

Trifluoroacetic acid (12 mL) was added to a solution of compound 127 (1.57 g, 2.02 mmol) in dichloromethane (12 mL) and stirred at room temperature for 1 h. The reaction mixture was co-evaporated with toluene (30 mL) under reduced pressure to dryness. The residue obtained was co-evaporated twice with acetonitrile (30 mL) and toluene (40 mL) to yield Compound 128 (1.67 g) as trifluoro acetate salt and used for next step without further purification. LCMS and $^1$H NMR were consistent with structure. Mass m/z 478.2 [M+H]$^+$.

Compound 7 (0.43 g, 0.963 mmol), HATU (0.35 g, 0.91 mmol), and HOAt (0.035 g, 0.26 mmol) were combined together and dried for 4 h over P$_2$O$_5$ under reduced pressure in a round bottom flask and then dissolved in anhydrous DMF (1 mL) and stirred for 5 min. To this a solution of compound 128 (0.20 g, 0.26 mmol) in anhydrous DMF (0.2 mL) and N,N-Diisopropylethylamine (0.2 mL) was added. The reaction mixture was stirred at room temperature under an argon atmosphere. The reaction was complete after 30 min as determined by LCMS and TLC (7% MeOH/DCM). The reaction mixture was concentrated under reduced pressure. The residue was dissolved in DCM (30 mL) and washed with 1 M NaHSO$_4$ (3×20 mL), aqueous saturated NaHCO$_3$ (3×20 mL) and brine (3×20 mL). The organic phase was separated, dried over Na$_2$SO$_4$, filtered and concentrated. The residue was purified by silica gel column chromatography using 5-15% MeOH in dichloromethane to yield Compound 129 (96.6 mg). LC MS and $^1$H NMR are consistent with structure. Mass m/z 883.4 [M+2H]$^+$.

Compound 129 (0.09 g, 0.051 mmol) was dissolved in methanol (5 mL) in 20 mL scintillation vial. To this was added a small amount of 10% Pd/C (0.015 mg) and the reaction vessel was flushed with H$_2$ gas. The reaction mixture was stirred at room temperature under H$_2$ atmosphere for 18 h. The reaction mixture was filtered through a pad of Celite and the Celite pad was washed with methanol. The filtrate washings were pooled together and concentrated under reduced pressure to yield Compound 130 (0.08 g). LCMS and $^1$H NMR were consistent with structure. The product was used without further purification. Mass m/z 838.3 [M+2H]$^+$.

To a 10 mL pointed round bottom flask were added compound 130 (75.8 mg, 0.046 mmol), 0.37 M pyridine/DMF (200 µL) and a stir bar. To this solution was added 0.7 M pentafluorophenyl trifluoroacetate/DMF (100 µL) drop wise with stirring. The reaction was completed after 1 h as determined by LC MS. The solvent was removed under reduced pressure and the residue was dissolved in CHCl$_3$ (~10 mL). The organic layer was partitioned against NaHSO$_4$ (1 M, 10 mL), aqueous saturated NaHCO$_3$ (10 mL) and brine (10 mL) three times each. The organic phase separated and dried over Na$_2$SO$_4$, filtered and concentrated to yield Compound 131 (77.7 mg). LCMS is consistent with structure. Used without further purification. Mass m/z 921.3 [M+2H]$^+$.

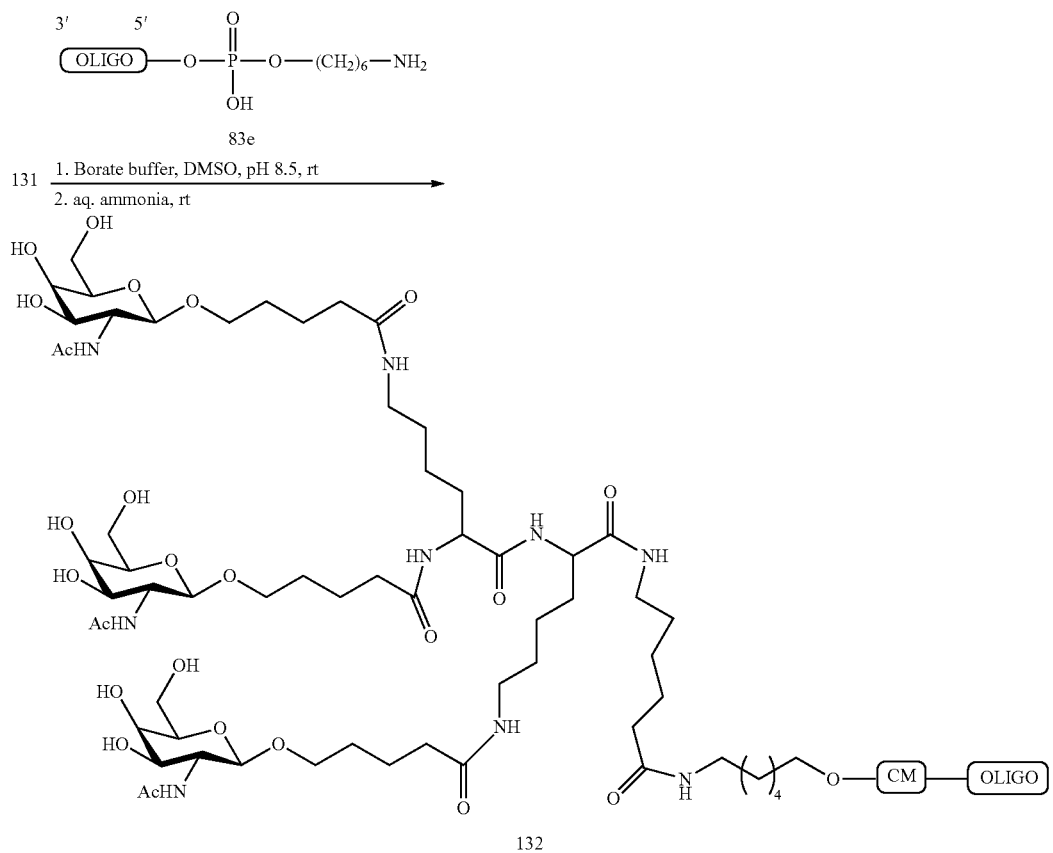

Oligomeric Compound 132, comprising a GalNAc$_3$-5 conjugate group, was prepared using the general procedures illustrated in Example 46. The GalNAc$_3$ cluster portion of the conjugate group GalNAc$_3$-5 (GalNAc$_3$-5$_a$) can be combined with any cleavable moiety to provide a variety of conjugate groups. In certain embodiments, the cleavable moiety is —P(=O)(OH)-A$_d$-P(=O)(OH)—.
The structure of GalNAc$_3$-5 (GalNAc$_3$-5$_a$-CM-) is shown below:
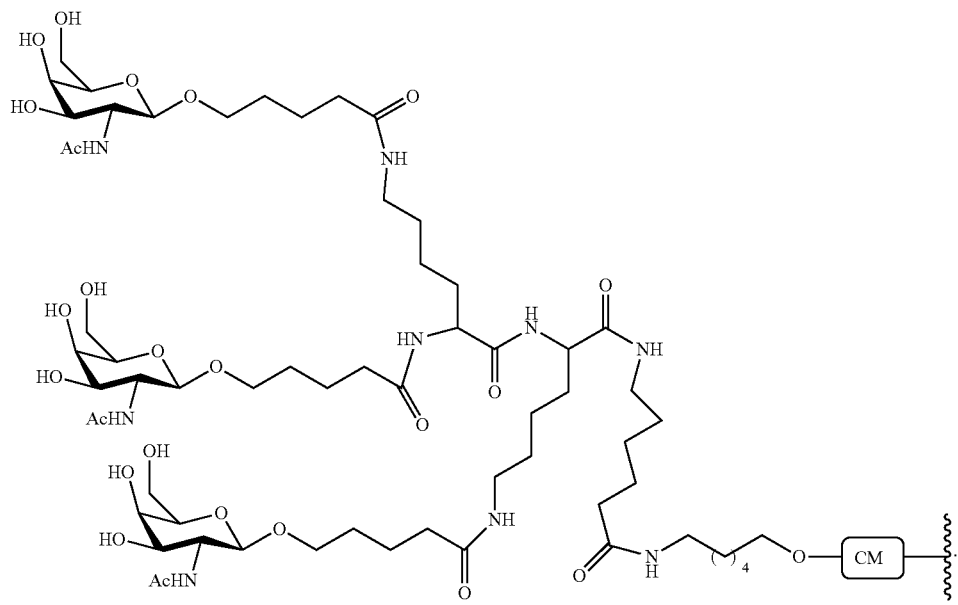
35
Example 50
Preparation of Oligonucleotide 144 Comprising GalNAc$_4$-11
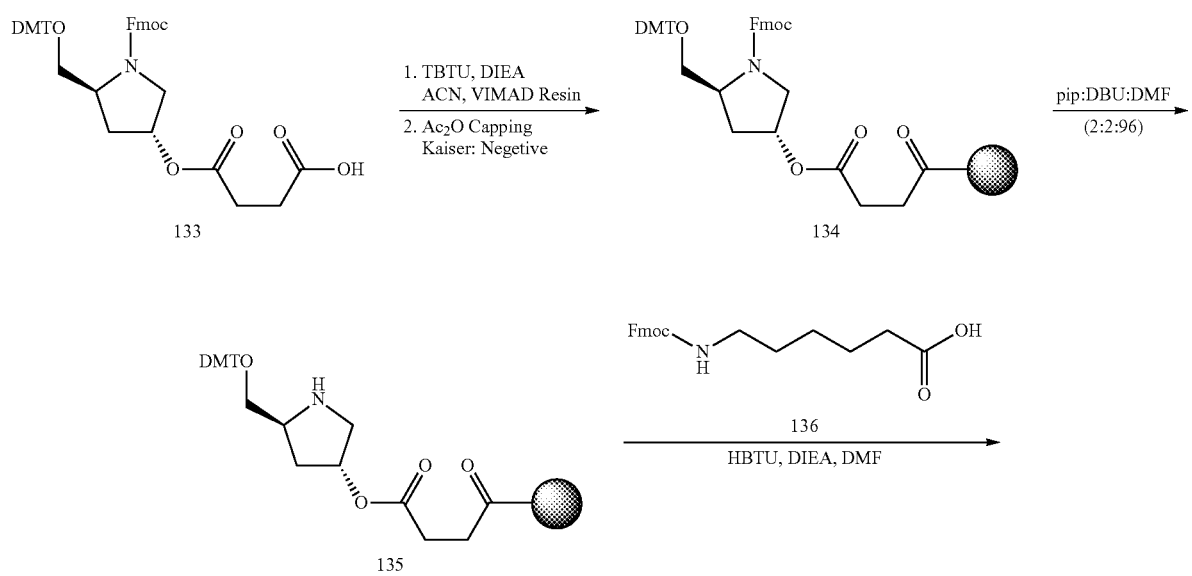

-continued
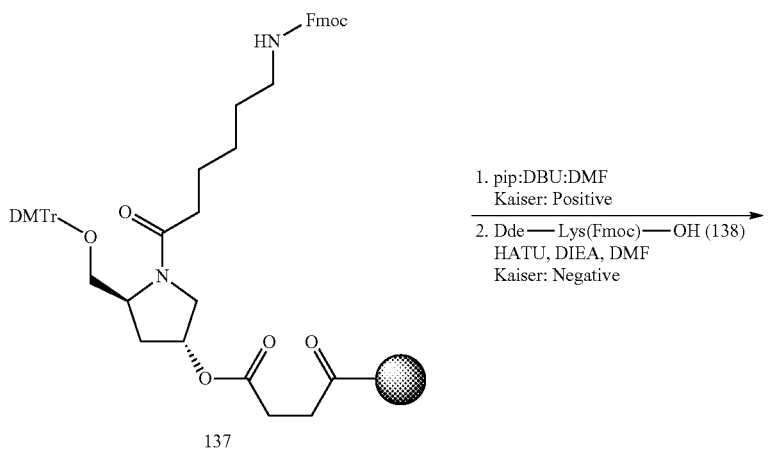
137
1. pip:DBU:DMF
   Kaiser: Positive
2. Dde—Lys(Fmoc)—OH (138)
   HATU, DIEA, DMF
   Kaiser: Negative
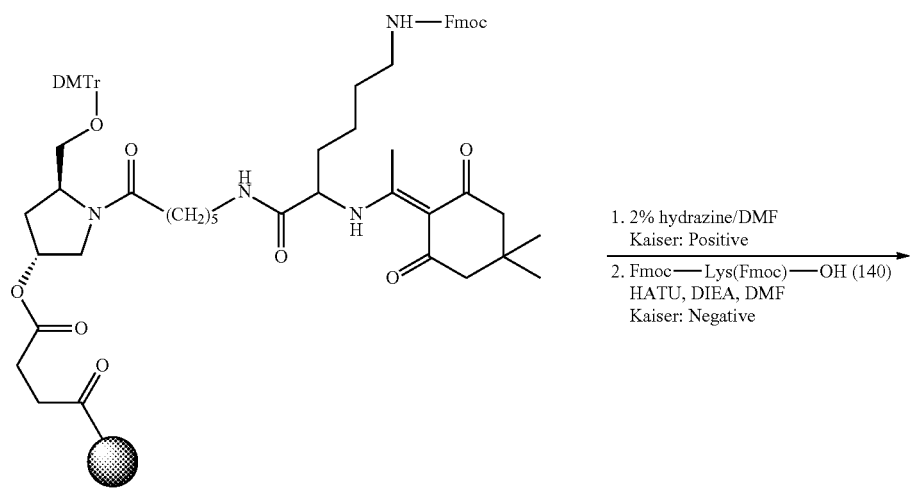
139
1. 2% hydrazine/DMF
   Kaiser: Positive
2. Fmoc—Lys(Fmoc)—OH (140)
   HATU, DIEA, DMF
   Kaiser: Negative
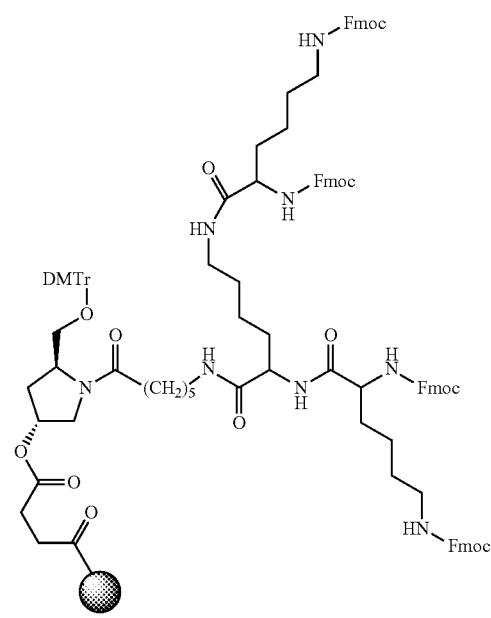
141

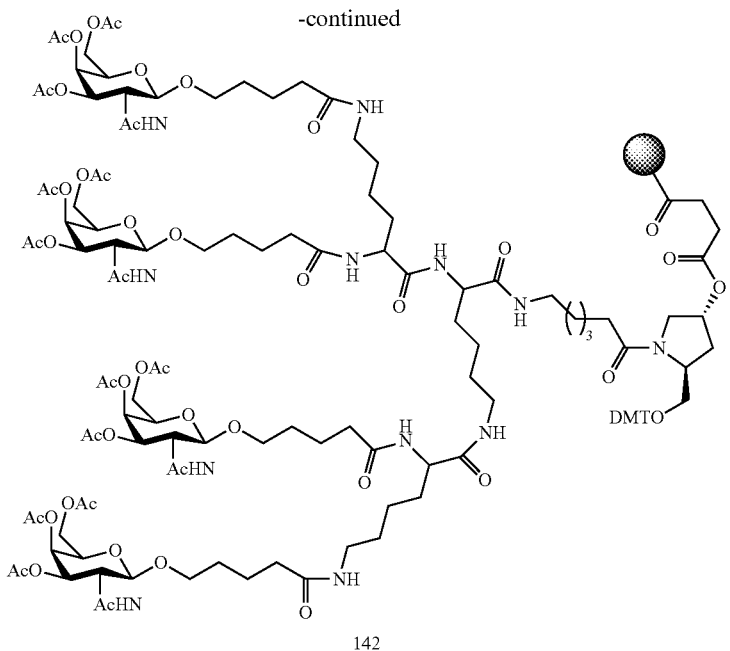

141 → 142

1. pip:DBU:DMF
   Kaiser: Positive
2. 7, HATU, DIEA, DMF
   Kaiser: Negative

Synthesis of Compound 134. To a Merrifield flask was added aminomethyl VIMAD resin (2.5 g, 450 µmol/g) that was washed with acetonitrile, dimethylformamide, dichloromethane and acetonitrile. The resin was swelled in acetonitrile (4 mL). Compound 133 was pre-activated in a 100 mL round bottom flask by adding 20 (1.0 mmol, 0.747 g), TBTU (1.0 mmol, 0.321 g), acetonitrile (5 mL) and DIEA (3.0 mmol, 0.5 mL). This solution was allowed to stir for 5 min and was then added to the Merrifield flask with shaking. The suspension was allowed to shake for 3 h. The reaction mixture was drained and the resin was washed with acetonitrile, DMF and DCM. New resin loading was quantitated by measuring the absorbance of the DMT cation at 500 nm (extinction coefficient=76000) in DCM and determined to be 238 µmol/g. The resin was capped by suspending in an acetic anhydride solution for ten minutes three times.

The solid support bound compound 141 was synthesized using iterative Fmoc-based solid phase peptide synthesis methods. A small amount of solid support was withdrawn and suspended in aqueous ammonia (28-30 wt %) for 6 h. The cleaved compound was analyzed by LC-MS and the observed mass was consistent with structure. Mass m/z 1063.8 [M+2H]$^+$.

The solid support bound compound 142 was synthesized using solid phase peptide synthesis methods.

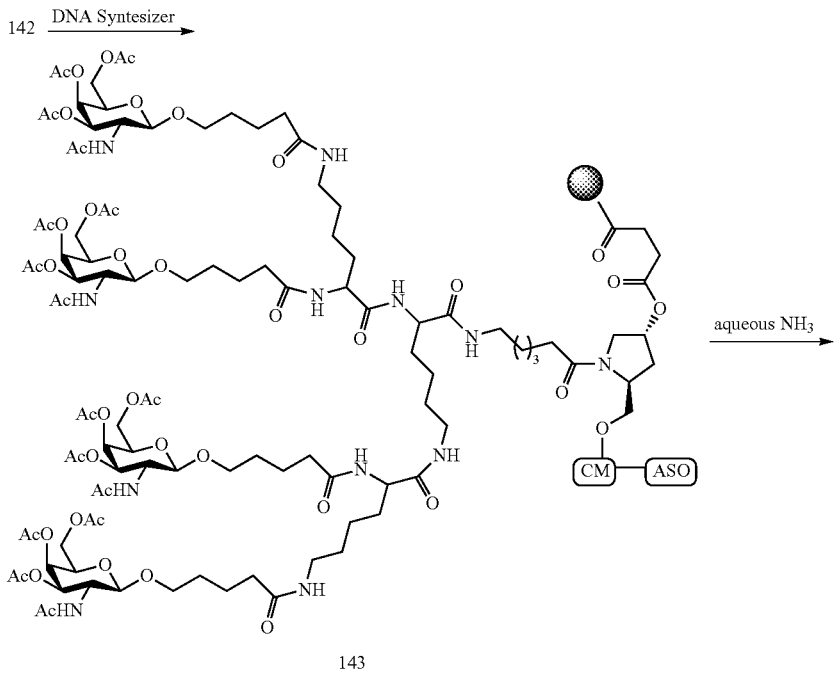

142 → (DNA Syntesizer) → 143 → aqueous NH$_3$

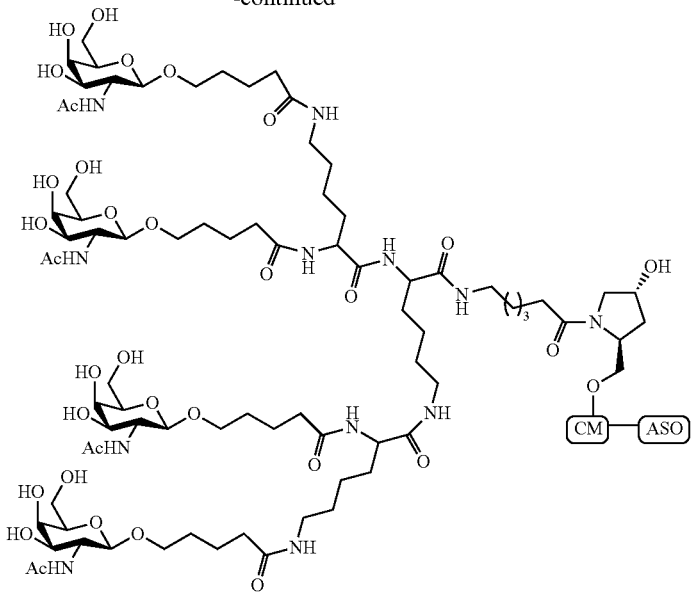

144

The solid support bound compound 143 was synthesized using standard solid phase synthesis on a DNA synthesizer.

The solid support bound compound 143 was suspended in aqueous ammonia (28-30 wt %) and heated at 55° C. for 16 h. The solution was cooled and the solid support was filtered. The filtrate was concentrated and the residue dissolved in water and purified by HPLC on a strong anion exchange column. The fractions containing full length compound 144 were pooled together and desalted. The resulting GalNAc$_4$-11 conjugated oligomeric compound was analyzed by LC-MS and the observed mass was consistent with structure.

The GalNAc$_4$ cluster portion of the conjugate group GalNAc$_4$-11 (GalNAc$_4$-11$_a$) can be combined with any cleavable moiety to provide a variety of conjugate groups. In certain embodiments, the cleavable moiety is —P(=O)(OH)-A$_d$-P(=O)(OH)—.

The structure of GalNAc$_4$-11 (GalNAc$_4$-11$_a$-CM) is shown below:

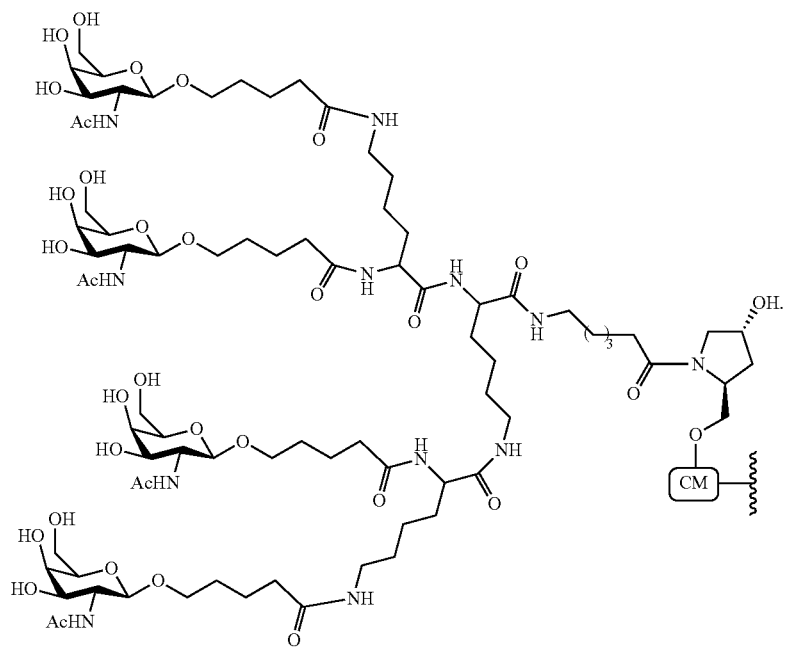

Example 51
Preparation of Oligonucleotide 155 Comprising GalNAc₃-6
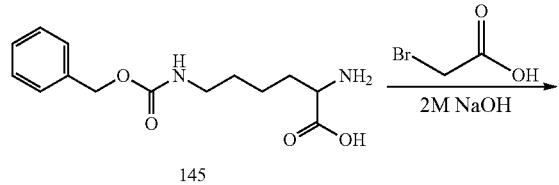
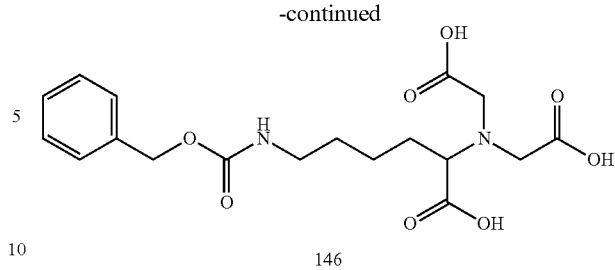
Compound 146 was synthesized as described in the literature (*Analytical Biochemistry* 1995, 229, 54-60).
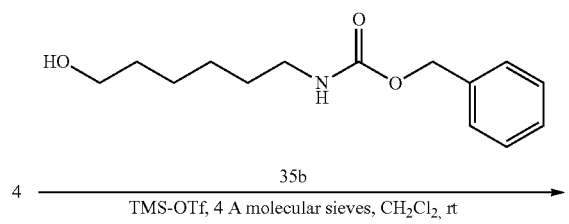
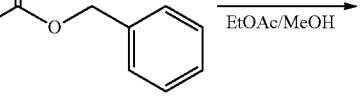
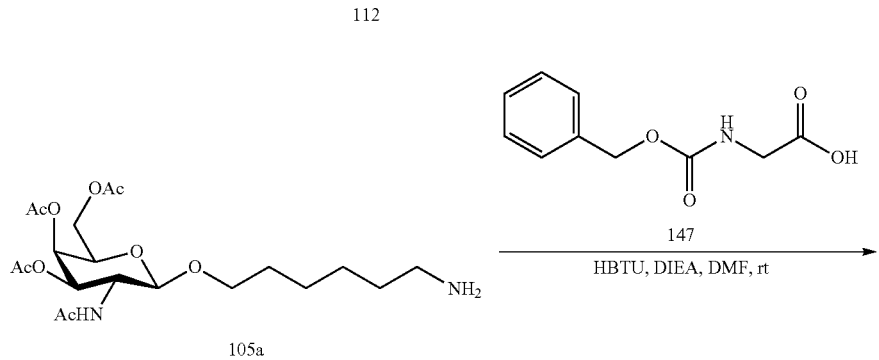
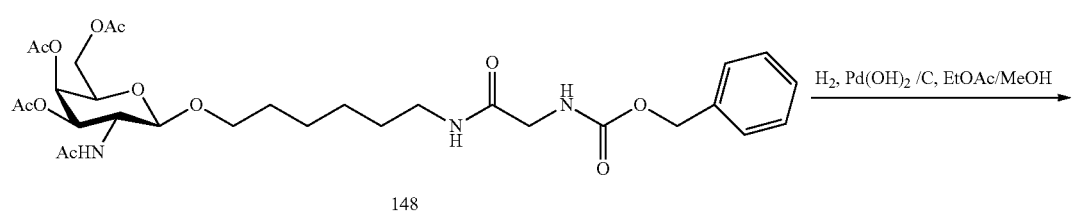
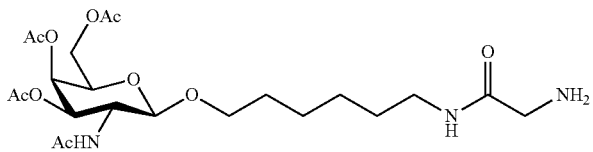

Compound 4 (15 g, 45.55 mmol) and compound 35b (14.3 grams, 57 mmol) were dissolved in $CH_2Cl_2$ (200 ml). Activated molecular sieves (4 Å, 2 g, powdered) were added, and the reaction was allowed to stir for 30 minutes under nitrogen atmosphere. TMS-OTf was added (4.1 ml, 22.77 mmol) and the reaction was allowed to stir at room temp overnight. Upon completion, the reaction was quenched by pouring into solution of saturated aqueous $NaHCO_3$ (500 ml) and crushed ice (~150 g). The organic layer was separated, washed with brine, dried over $MgSO_4$, filtered, and was concentrated to an orange oil under reduced pressure. The crude material was purified by silica gel column chromatography and eluted with 2-10% MeOH in $CH_2Cl_2$ to yield Compound 112 (16.53 g, 63%). LCMS and $^1H$ NMR were consistent with the expected compound.

Compound 112 (4.27 g, 7.35 mmol) was dissolved in 1:1 MeOH/EtOAc (40 ml). The reaction mixture was purged by bubbling a stream of argon through the solution for 15 minutes. Pearlman's catalyst (palladium hydroxide on carbon, 400 mg) was added, and hydrogen gas was bubbled through the solution for 30 minutes. Upon completion (TLC 10% MeOH in $CH_2Cl_2$, and LCMS), the catalyst was removed by filtration through a pad of celite. The filtrate was concentrated by rotary evaporation, and was dried briefly under high vacuum to yield Compound 105a (3.28 g). LCMS and 1H NMR were consistent with desired product.

Compound 147 (2.31 g, 11 mmol) was dissolved in anhydrous DMF (100 mL). N,N-Diisopropylethylamine (DIEA, 3.9 mL, 22 mmol) was added, followed by HBTU (4 g, 10.5 mmol). The reaction mixture was allowed to stir for ~15 minutes under nitrogen. To this a solution of compound 105a (3.3 g, 7.4 mmol) in dry DMF was added and stirred for 2 h under nitrogen atmosphere. The reaction was diluted with EtOAc and washed with saturated aqueous $NaHCO_3$ and brine. The organics phase was separated, dried ($MgSO_4$), filtered, and concentrated to an orange syrup. The crude material was purified by column chromatography 2-5% MeOH in $CH_2Cl_2$ to yield Compound 148 (3.44 g, 73%). LCMS and $^1H$ NMR were consistent with the expected product.

Compound 148 (3.3 g, 5.2 mmol) was dissolved in 1:1 MeOH/EtOAc (75 ml). The reaction mixture was purged by bubbling a stream of argon through the solution for 15 minutes. Pearlman's catalyst (palladium hydroxide on carbon) was added (350 mg). Hydrogen gas was bubbled through the solution for 30 minutes. Upon completion (TLC 10% MeOH in DCM, and LCMS), the catalyst was removed by filtration through a pad of celite. The filtrate was concentrated by rotary evaporation, and was dried briefly under high vacuum to yield Compound 149 (2.6 g). LCMS was consistent with desired product. The residue was dissolved in dry DMF (10 ml) was used immediately in the next step.

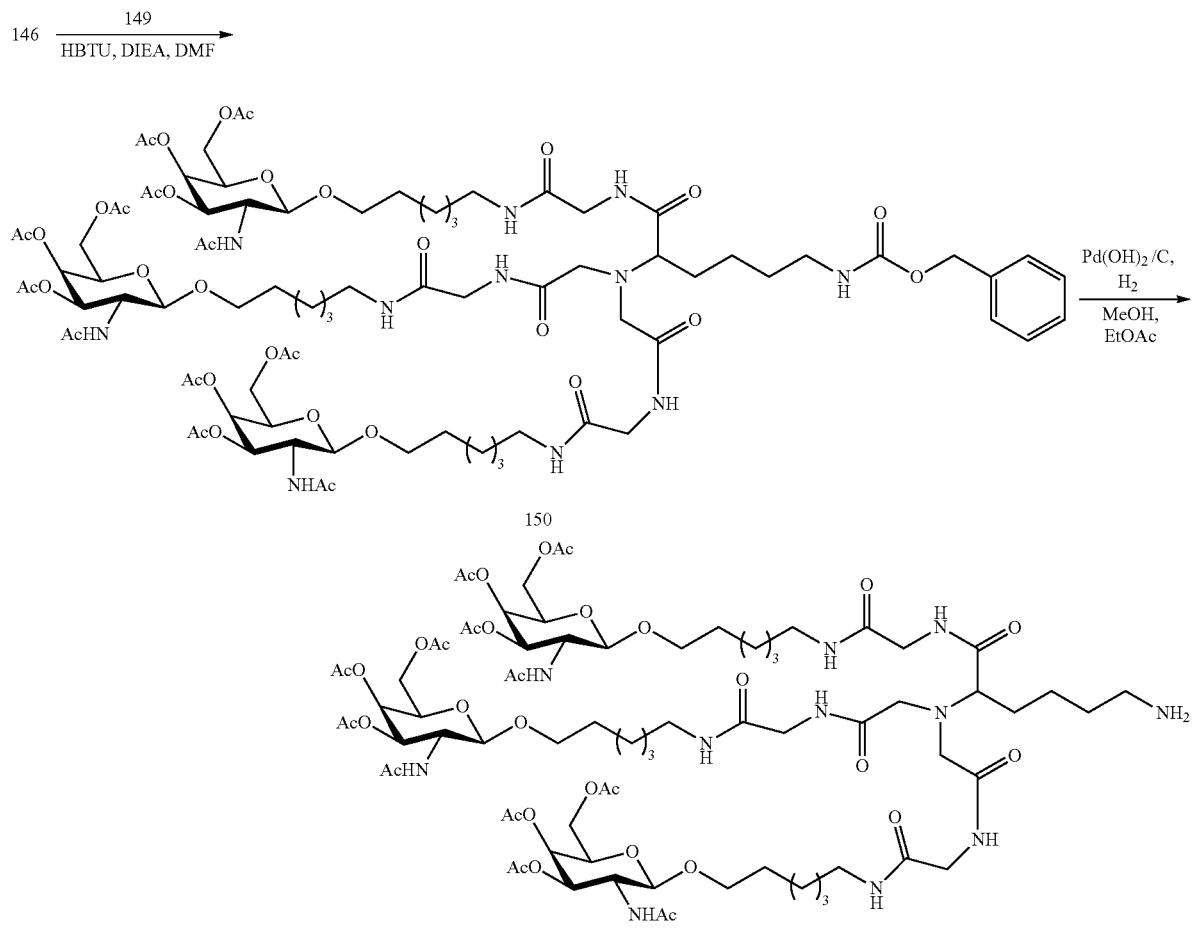

Compound 146 (0.68 g, 1.73 mmol) was dissolved in dry DMF (20 ml). To this DIEA (450 µL, 2.6 mmol, 1.5 eq.) and HBTU (1.96 g, 0.5.2 mmol) were added. The reaction mixture was allowed to stir for 15 minutes at room temperature under nitrogen. A solution of compound 149 (2.6 g) in anhydrous DMF (10 mL) was added. The pH of the reaction was adjusted to pH=9-10 by addition of DIEA (if necessary). The reaction was allowed to stir at room temperature under nitrogen for 2 h. Upon completion the reaction was diluted with EtOAc (100 mL), and washed with aqueous saturated aqueous $NaHCO_3$, followed by brine. The organic phase was separated, dried over $MgSO_4$, filtered, and concentrated. The residue was purified by silica gel column chromatography and eluted with 2-10% MeOH in $CH_2Cl_2$ to yield Compound 150 (0.62 g, 20%). LCMS and $^1H$ NMR were consistent with the desired product.

Compound 150 (0.62 g) was dissolved in 1:1 MeOH/EtOAc (5 L). The reaction mixture was purged by bubbling a stream of argon through the solution for 15 minutes. Pearlman's catalyst (palladium hydroxide on carbon) was added (60 mg). Hydrogen gas was bubbled through the solution for 30 minutes. Upon completion (TLC 10% MeOH in DCM, and LCMS), the catalyst was removed by filtration (syringe-tip Teflon filter, 0.45 µm). The filtrate was concentrated by rotary evaporation, and was dried briefly under high vacuum to yield Compound 151 (0.57 g). The LCMS was consistent with the desired product. The product was dissolved in 4 mL dry DMF and was used immediately in the next step.

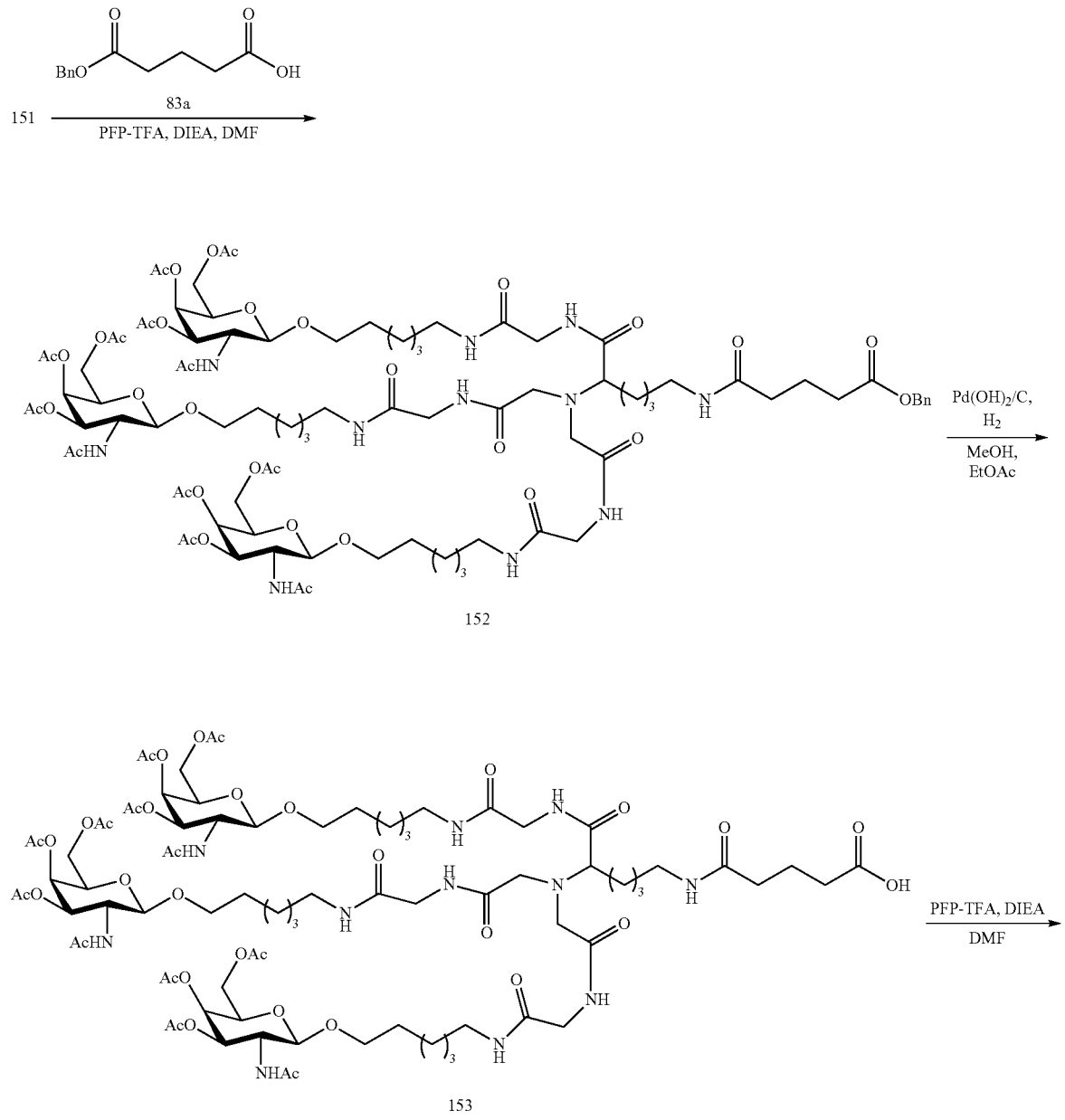

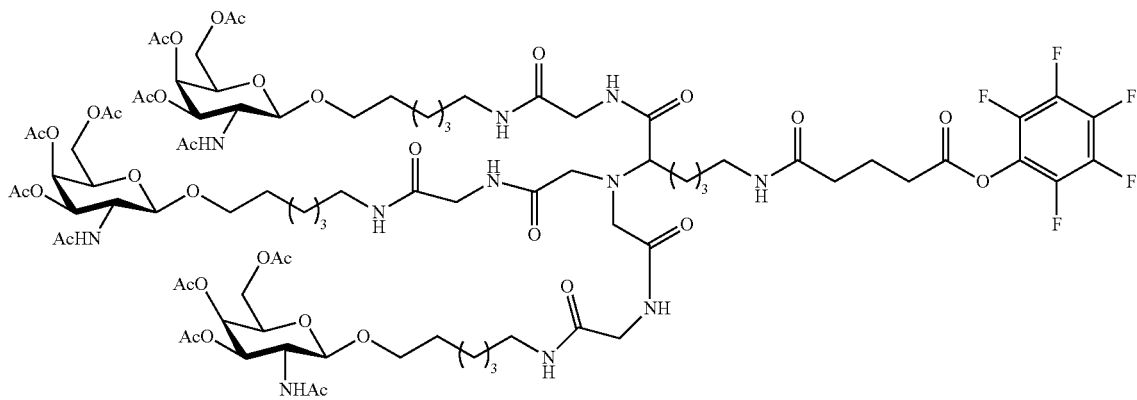

154

Compound 83a (0.11 g, 0.33 mmol) was dissolved in anhydrous DMF (5 mL) and N,N-Diisopropylethylamine (75 µL, 1 mmol) and PFP-TFA (90 µL, 0.76 mmol) were added. The reaction mixture turned magenta upon contact, and gradually turned orange over the next 30 minutes. Progress of reaction was monitored by TLC and LCMS. Upon completion (formation of the PFP ester), a solution of compound 151 (0.57 g, 0.33 mmol) in DMF was added. The pH of the reaction was adjusted to pH=9-10 by addition of N,N-Diisopropylethylamine (if necessary). The reaction mixture was stirred under nitrogen for ~30 min. Upon completion, the majority of the solvent was removed under reduced pressure. The residue was diluted with CH$_2$Cl$_2$ and washed with aqueous saturated NaHCO$_3$, followed by brine. The organic phase separated, dried over MgSO$_4$, filtered, and concentrated to an orange syrup. The residue was purified by silica gel column chromatography (2-10% MeOH in CH$_2$Cl$_2$) to yield Compound 152 (0.35 g, 55%). LCMS and $^1$H NMR were consistent with the desired product.

Compound 152 (0.35 g, 0.182 mmol) was dissolved in 1:1 MeOH/EtOAc (10 mL). The reaction mixture was purged by bubbling a stream of argon thru the solution for 15 minutes. Pearlman's catalyst (palladium hydroxide on carbon) was added (35 mg). Hydrogen gas was bubbled thru the solution for 30 minutes. Upon completion (TLC 10% MeOH in DCM, and LCMS), the catalyst was removed by filtration (syringe-tip Teflon filter, 0.45 µm). The filtrate was concentrated by rotary evaporation, and was dried briefly under high vacuum to yield Compound 153 (0.33 g, quantitative). The LCMS was consistent with desired product.

Compound 153 (0.33 g, 0.18 mmol) was dissolved in anhydrous DMF (5 mL) with stirring under nitrogen. To this N,N-Diisopropylethylamine (65 µL, 0.37 mmol) and PFP-TFA (35 µL, 0.28 mmol) were added. The reaction mixture was stirred under nitrogen for ~30 min. The reaction mixture turned magenta upon contact, and gradually turned orange. The pH of the reaction mixture was maintained at pH=9-10 by adding more N,-Diisopropylethylamine. The progress of the reaction was monitored by TLC and LCMS. Upon completion, the majority of the solvent was removed under reduced pressure. The residue was diluted with CH$_2$Cl$_2$ (50 mL), and washed with saturated aqueous NaHCO$_3$, followed by brine. The organic layer was dried over MgSO$_4$, filtered, and concentrated to an orange syrup. The residue was purified by column chromatography and eluted with 2-10% MeOH in CH$_2$Cl$_2$ to yield Compound 154 (0.29 g, 79%). LCMS and $^1$H NMR were consistent with the desired product.

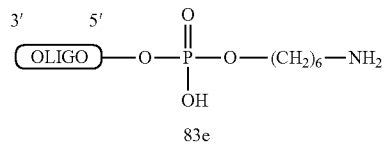

83e

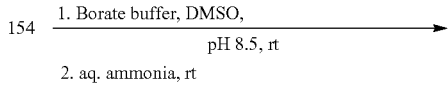

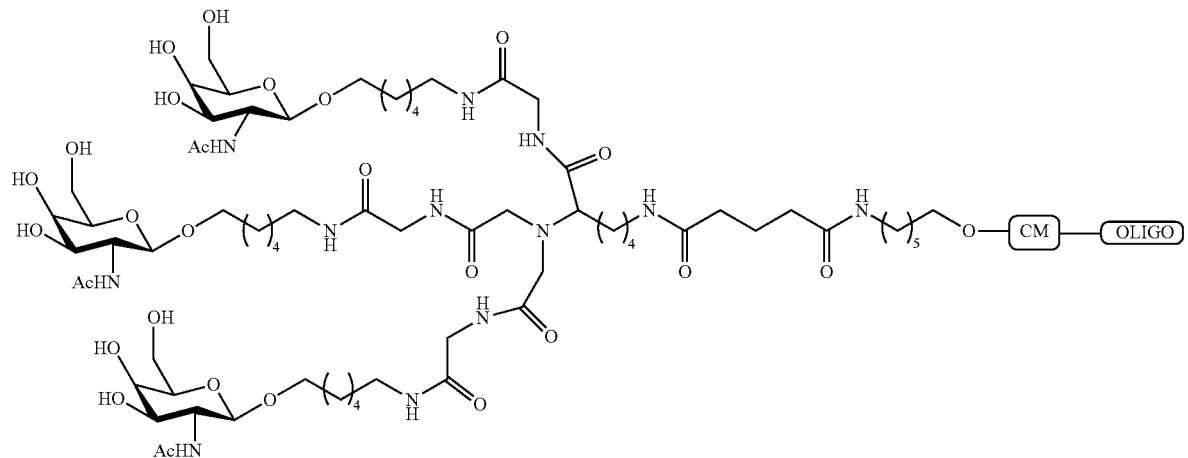

155

Oligomeric Compound 155, comprising a GalNAc$_3$-6 conjugate group, was prepared using the general procedures illustrated in Example 46. The GalNAc$_3$ cluster portion of the conjugate group GalNAc$_3$-6 (GalNAc$_3$-6$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-6 (GalNAc$_3$-6$_a$-CM-) is shown below:

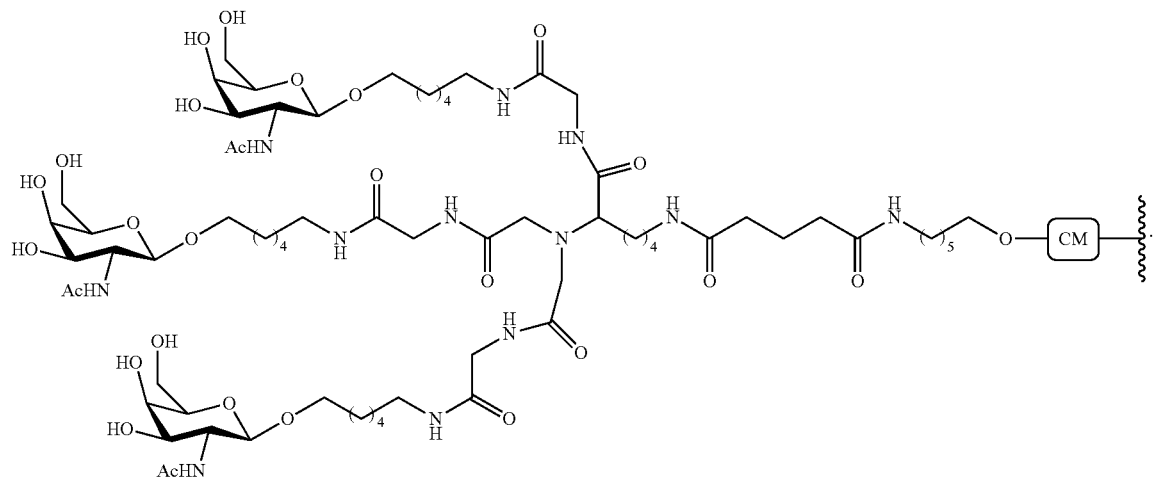

Example 52

Preparation of Oligonucleotide 160 Comprising GalNAc₃-9

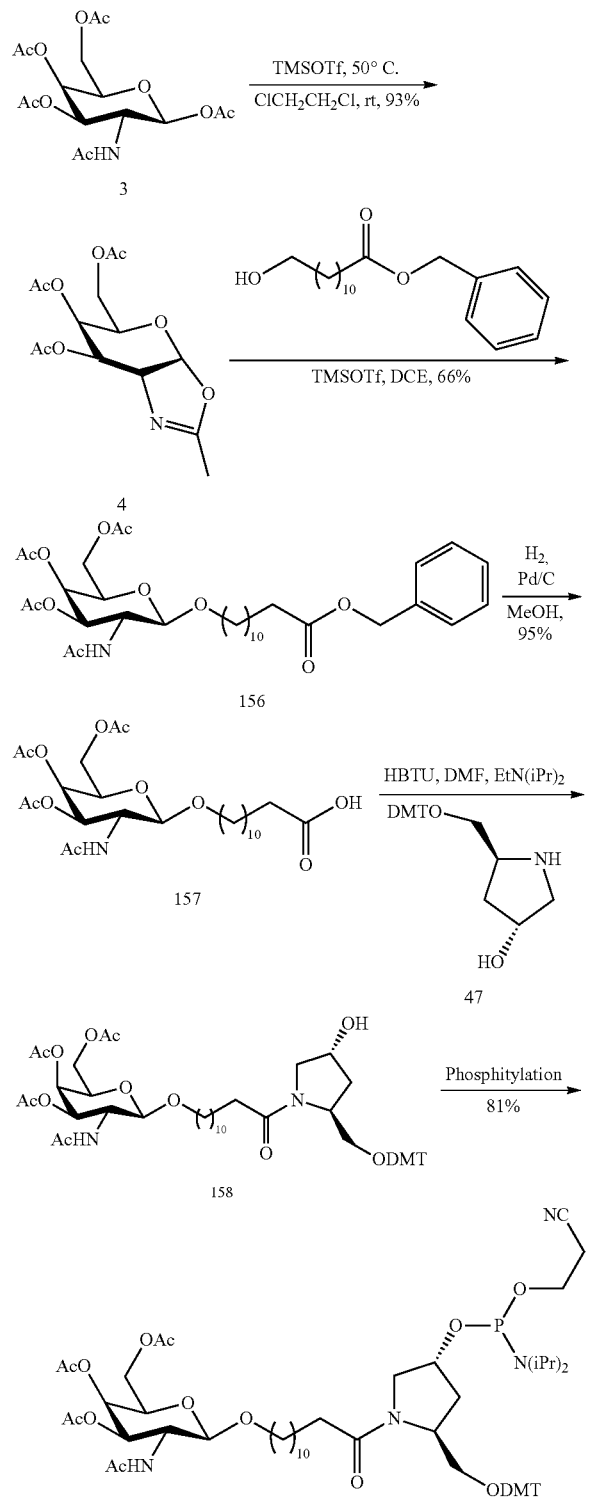

Compound 156 was synthesized following the procedure described in the literature (*J. Med. Chem.* 2004, 47, 5798-5808).

Compound 156, (18.60 g, 29.28 mmol) was dissolved in methanol (200 mL). Palladium on carbon (6.15 g, 10 wt %, loading (dry basis), matrix carbon powder, wet) was added. The reaction mixture was stirred at room temperature under hydrogen for 18 h. The reaction mixture was filtered through a pad of celite and the celite pad was washed thoroughly with methanol. The combined filtrate was washed and concentrated to dryness. The residue was purified by silica gel column chromatography and eluted with 5-10% methanol in dichloromethane to yield Compound 157 (14.26 g, 89%). Mass m/z 544.1 [M−H]⁻.

Compound 157 (5 g, 9.17 mmol) was dissolved in anhydrous DMF (30 mL). HBTU (3.65 g, 9.61 mmol) and N,N-Diisopropylethylamine (13.73 mL, 78.81 mmol) were added and the reaction mixture was stirred at room temperature for 5 minutes. To this a solution of compound 47 (2.96 g, 7.04 mmol) was added. The reaction was stirred at room temperature for 8 h. The reaction mixture was poured into a saturated NaHCO₃ aqueous solution. The mixture was extracted with ethyl acetate and the organic layer was washed with brine and dried (Na₂SO₄), filtered and evaporated. The residue obtained was purified by silica gel column chromatography and eluted with 50% ethyl acetate in hexane to yield compound 158 (8.25 g, 73.3%). The structure was confirmed by MS and ¹H NMR analysis.

Compound 158 (7.2 g, 7.61 mmol) was dried over P₂O₅ under reduced pressure. The dried compound was dissolved in anhydrous DMF (50 mL). To this 1H-tetrazole (0.43 g, 6.09 mmol) and N-methylimidazole (0.3 mL, 3.81 mmol) and 2-cyanoethyl-N,N,N',N'-tetraisopropyl phosphorodiamidite (3.65 mL, 11.50 mmol) were added. The reaction mixture was stirred t under an argon atmosphere for 4 h. The reaction mixture was diluted with ethyl acetate (200 mL). The reaction mixture was washed with saturated NaHCO₃ and brine. The organic phase was separated, dried (Na₂SO₄), filtered and evaporated. The residue was purified by silica gel column chromatography and eluted with 50-90% ethyl acetate in hexane to yield Compound 159 (7.82 g, 80.5%). The structure was confirmed by LCMS and ³¹P NMR analysis.

315

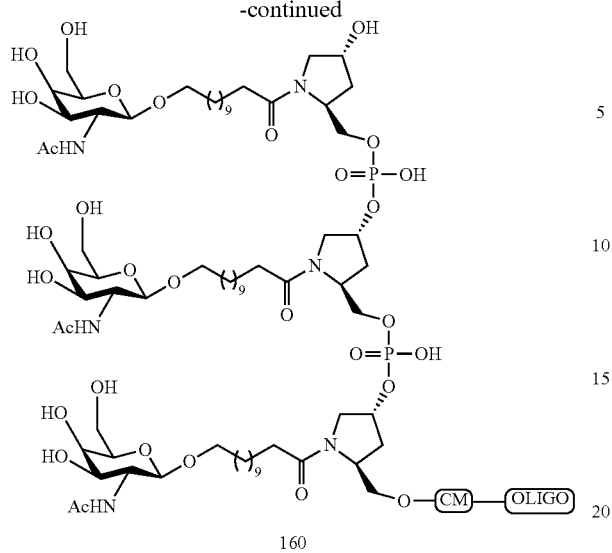

160

Oligomeric Compound 160, comprising a GalNAc$_3$-9 conjugate group, was prepared using standard oligonucleotide synthesis procedures. Three units of compound 159 were coupled to the solid support, followed by nucleotide phosphoramidites. Treatment of the protected oligomeric compound with aqueous ammonia yielded compound 160. The GalNAc$_3$ cluster portion of the conjugate group GalNAc$_3$-9 (GalNAc$_3$-9$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-9 (GalNAc$_3$-9$_a$-CM) is shown below:

316

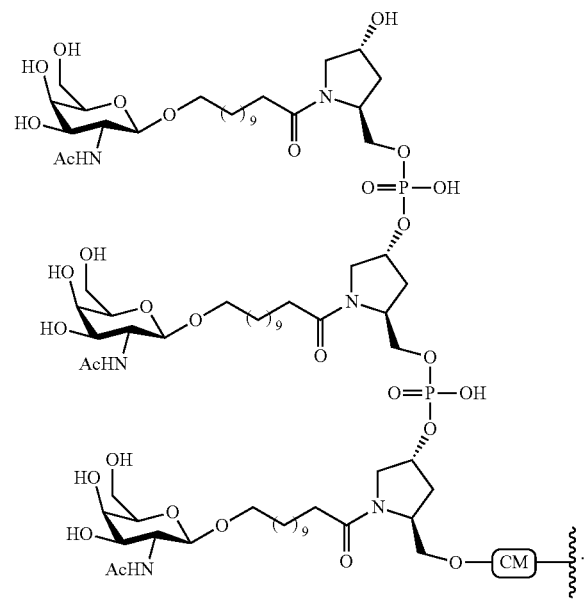

Example 53

Alternate Procedure for Preparation of Compound 18 (GalNAc$_3$-1a and GalNAc$_3$-3a)

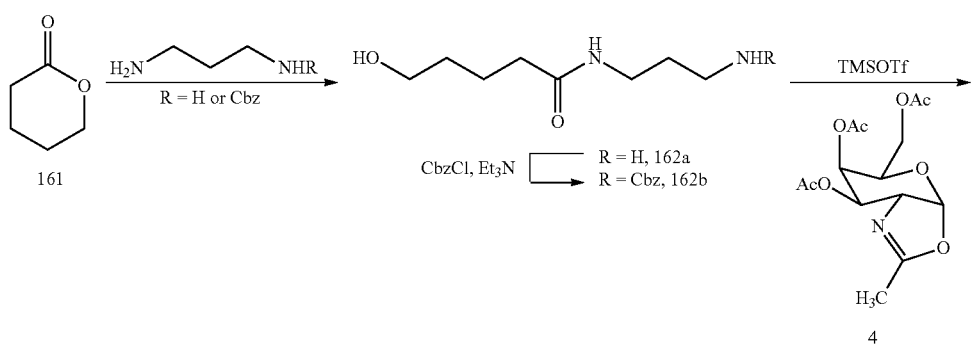

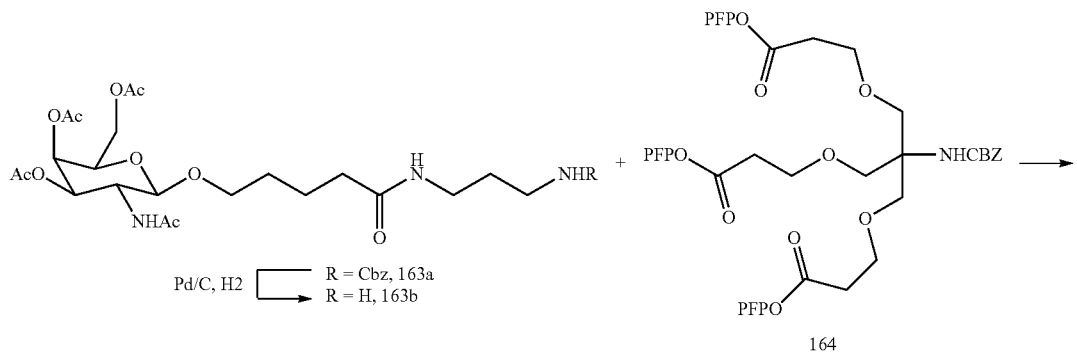

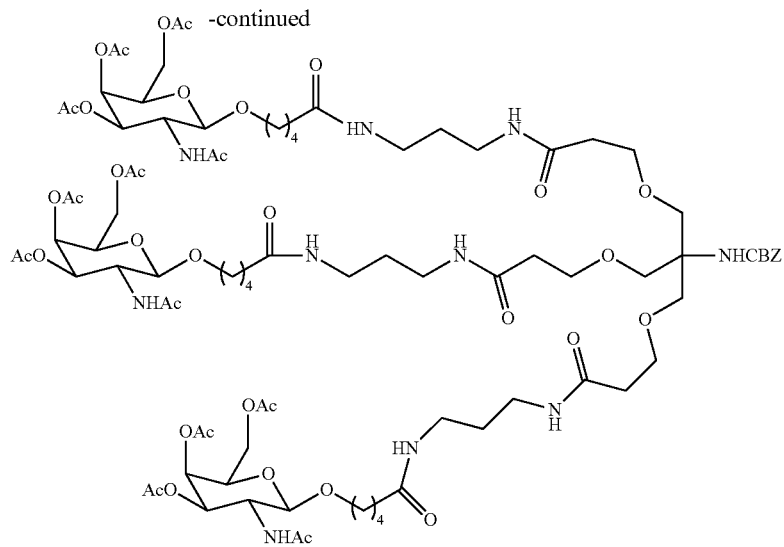

18

Lactone 161 was reacted with diamino propane (3-5 eq) or Mono-Boc protected diamino propane (1 eq) to provide alcohol 162a or 162b. When unprotected propanediamine was used for the above reaction, the excess diamine was removed by evaporation under high vacuum and the free amino group in 162a was protected using CbzCl to provide 162b as a white solid after purification by column chromatography. Alcohol 162b was further reacted with compound 4 in the presence of TMSOTf to provide 163a which was converted to 163b by removal of the Cbz group using catalytic hydrogenation. The pentafluorophenyl (PFP) ester 164 was prepared by reacting triacid 113 (see Example 48) with PFPTFA (3.5 eq) and pyridine (3.5 eq) in DMF (0.1 to 0.5 M). The triester 164 was directly reacted with the amine 163b (3-4 eq) and DIPEA (3-4 eq) to provide Compound 18. The above method greatly facilitates purification of intermediates and minimizes the formation of byproducts which are formed using the procedure described in Example 4.

Example 54

Alternate Procedure for Preparation of Compound 18 (GalNAc$_3$-1$_a$ and GalNAc$_3$-3a)

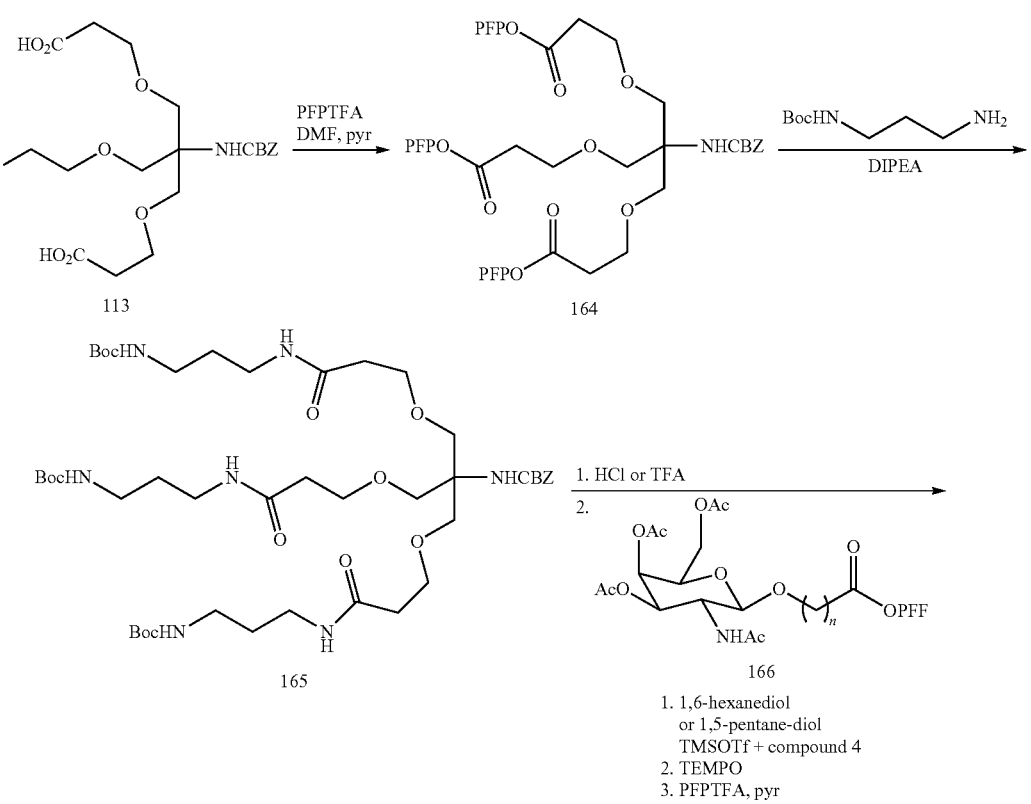

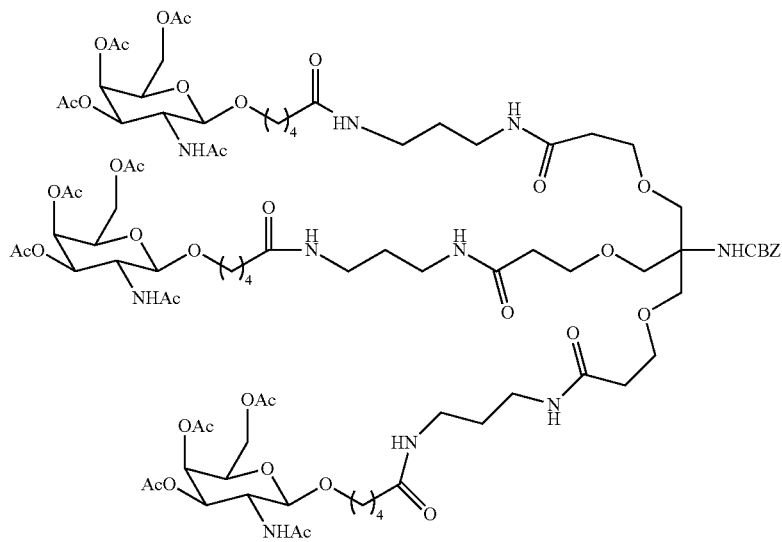

18

The triPFP ester 164 was prepared from acid 113 using the procedure outlined in example 53 above and reacted with mono-Boc protected diamine to provide 165 in essentially quantitative yield. The Boc groups were removed with hydrochloric acid or trifluoroacetic acid to provide the triamine which was reacted with the PFP activated acid 166 in the presence of a suitable base such as DIPEA to provide Compound 18.

The PFP protected Gal-NAc acid 166 was prepared from the corresponding acid by treatment with PFPTFA (1-1.2 eq) and pyridine (1-1.2 eq) in DMF. The precursor acid in turn was prepared from the corresponding alcohol by oxidation using TEMPO (0.2 eq) and BAIB in acetonitrile and water. The precursor alcohol was prepared from sugar intermediate 4 by reaction with 1,6-hexanediol (or 1,5-pentanediol or other diol for other n values) (2-4 eq) and TMSOTf using conditions described previously in example 47.

Example 55

Dose-dependent Study of Oligonucleotides Comprising Either a 3' or 5'-Conjugate Group (Comparison of GalNAc$_3$-1, 3, 8 and 9) Targeting SRB-1 In Vivo The oligonucleotides listed below were tested in a dose-dependent study for antisense inhibition of SRB-1 in mice. Unconjugated ISIS 353382 was included as a standard. Each of the various GalNAc$_3$ conjugate groups was attached at either the 3' or 5' terminus of the respective oligonucleotide by a phosphodiester linked 2'-deoxyadenosine nucleoside (cleavable moiety).

TABLE 39

Modified ASO targeting SRB-1

| ASO | Sequence (5' to 3') | Motif | Conjugate | SEQ ID No. |
|---|---|---|---|---|
| ISIS 353382 (parent) | G$_{es}$$^m$C$_{es}$T$_{es}$T$_{es}$$^m$C$_{es}$ A$_{ds}$G$_{ds}$T$_{ds}$$^m$C$_{ds}$A$_{ds}$ T$_{ds}$G$_{ds}$A$_{ds}$$^m$C$_{ds}$T$_{ds}$ T$_{es}$$^m$C$_{es}$$^m$C$_{es}$T$_{es}$T$_e$ | 5/10/5 | none | 2256 |
| ISIS 655861 | G$_{es}$$^m$C$_{es}$T$_{es}$T$_{es}$$^m$C$_{es}$ A$_{ds}$G$_{ds}$T$_{ds}$$^m$C$_{ds}$A$_{ds}$ T$_{ds}$G$_{ds}$A$_{ds}$$^m$C$_{ds}$T$_{ds}$ T$_{es}$$^m$C$_{es}$$^m$C$_{es}$T$_{es}$T$_{eo}$ A$_{do'}$-GalNAc$_3$-1$_a$ | 5/10/5 | GalNAc$_3$-1 | 2257 |
| ISIS 664078 | G$_{es}$$^m$C$_{es}$T$_{es}$T$_{es}$$^m$C$_{es}$ A$_{ds}$G$_{ds}$T$_{ds}$$^m$C$_{ds}$A$_{ds}$ T$_{ds}$G$_{ds}$A$_{ds}$$^m$C$_{ds}$T$_{ds}$ T$_{es}$$^m$C$_{es}$$^m$C$_{es}$T$_{es}$T$_{eo}$ A$_{do'}$-GalNAc$_3$-9$_a$ | 5/10/5 | GalNAc$_3$-9 | 2257 |
| ISIS 661161 | GalNAc$_3$-3$_{a-o'}$A$_{do}$ G$_{es}$$^m$C$_{es}$T$_{es}$T$_{es}$$^m$C$_{es}$ A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$ $^m$C$_{es}$$^m$C$_{es}$T$_{es}$T$_e$ | 5/10/5 | GalNAc$_3$-3 | 2258 |
| ISIS 665001 | GalNAc$_3$-8$_{a-o'}$A$_{do}$ G$_{es}$$^m$C$_{es}$T$_{es}$T$_{es}$$^m$C$_{es}$ A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$ $^m$C$_{es}$$^m$C$_{es}$T$_{es}$T$_e$ | 5/10/5 | GalNAc$_3$-8 | 2258 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9. The structure of GalNAc$_3$-9 was shown previously in Example 52. The structure of GalNAc$_3$-3 was shown previously in Example 39. The structure of GalNAc$_3$-8 was shown previously in Example 47.

Treatment

Six week old male Balb/c mice (Jackson Laboratory, Bar Harbor, Me.) were injected subcutaneously once at the dosage shown below with ISIS 353382, 655861, 664078, 661161, 665001 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 40, treatment with antisense oligonucleotides lowered SRB-1 mRNA levels in a dose-dependent manner. Indeed, the antisense oligonucleotides comprising the phosphodiester linked GalNAc$_3$-1 and GalNAc$_3$-9 conjugates at the 3' terminus (ISIS 655861 and ISIS 664078) and the GalNAc$_3$-3 and GalNAc$_3$-8 conjugates linked at the 5' terminus (ISIS 661161 and ISIS 665001) showed substantial improvement in potency compared to the unconjugated antisense oligonucleotide (ISIS 353382). Furthermore, ISIS 664078, comprising a GalNAc$_3$-9 conjugate at the 3' terminus was essentially equipotent compared to ISIS 655861, which comprises a GalNAc$_3$-1 conjugate at the 3' terminus. The 5' conjugated antisense oligonucleotides, ISIS 661161 and ISIS 665001, comprising a GalNAc$_3$-3 or GalNAc$_3$-9, respectively, had increased potency compared to the 3' conjugated antisense oligonucleotides (ISIS 655861 and ISIS 664078).

TABLE 40

ASOs containing GalNAc$_3$-1, 3, 8 or 9 targeting SRB-1

| ISIS No. | Dosage (mg/kg) | SRB-1 mRNA (% Saline) | Conjugate |
|---|---|---|---|
| Saline | n/a | 100 | |
| 353382 | 3 | 88 | none |
| | 10 | 68 | |
| | 30 | 36 | |
| 655861 | 0.5 | 98 | GalNac$_3$-1 (3') |
| | 1.5 | 76 | |
| | 5 | 31 | |
| | 15 | 20 | |
| 664078 | 0.5 | 88 | GalNac$_3$-9 (3') |
| | 1.5 | 85 | |
| | 5 | 46 | |
| | 15 | 20 | |
| 661161 | 0.5 | 92 | GalNac$_3$-3 (5') |
| | 1.5 | 59 | |
| | 5 | 19 | |
| | 15 | 11 | |
| 665001 | 0.5 | 100 | GalNac$_3$-8 (5') |
| | 1.5 | 73 | |
| | 5 | 29 | |
| | 15 | 13 | |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in the table below.

TABLE 41

| ISIS No. | Dosage mg/kg | ALT | AST | Total Bilirubin | BUN | Conjugate |
|---|---|---|---|---|---|---|
| Saline | | 24 | 59 | 0.1 | 37.52 | |
| 353382 | 3 | 21 | 66 | 0.2 | 34.65 | none |
| | 10 | 22 | 54 | 0.2 | 34.2 | |
| | 30 | 22 | 49 | 0.2 | 33.72 | |
| 655861 | 0.5 | 25 | 62 | 0.2 | 30.65 | GalNac$_3$-1 (3') |
| | 1.5 | 23 | 48 | 0.2 | 30.97 | |
| | 5 | 28 | 49 | 0.1 | 32.92 | |
| | 15 | 40 | 97 | 0.1 | 31.62 | |
| 664078 | 0.5 | 40 | 74 | 0.1 | 35.3 | GalNac$_3$-9 (3') |
| | 1.5 | 47 | 104 | 0.1 | 32.75 | |
| | 5 | 20 | 43 | 0.1 | 30.62 | |
| | 15 | 38 | 92 | 0.1 | 26.2 | |
| 661161 | 0.5 | 101 | 162 | 0.1 | 34.17 | GalNac$_3$-3 (5') |
| | 1.5 g | 42 | 100 | 0.1 | 33.37 | |
| | 5 g | 23 | 99 | 0.1 | 34.97 | |
| | 15 | 53 | 83 | 0.1 | 34.8 | |
| 665001 | 0.5 | 28 | 54 | 0.1 | 31.32 | GalNac$_3$-8 (5') |
| | 1.5 | 42 | 75 | 0.1 | 32.32 | |
| | 5 | 24 | 42 | 0.1 | 31.85 | |
| | 15 | 32 | 67 | 0.1 | 31. | |

Example 56

Dose-dependent Study of Oligonucleotides Comprising Either a 3' or 5'-Conjugate Group (Comparison of GalNAc$_3$-1, 2, 3, 5, 6, 7 and 10) Targeting SRB-1 In Vivo The oligonucleotides listed below were tested in a dose-dependent study for antisense inhibition of SRB-1 in mice. Unconjugated ISIS 353382 was included as a standard. Each of the various GalNAc$_3$ conjugate groups was attached at the 5' terminus of the respective oligonucleotide by a phosphodiester linked 2'-deoxyadenosine nucleoside (cleavable moiety) except for ISIS 655861 which had the GalNAc$_3$ conjugate group attached at the 3' terminus.

TABLE 42

Modified ASO targeting SRB-1

| ASO | Sequence (5' to 3') | Motif | Conjugate | SEQ ID No. |
|---|---|---|---|---|
| ISIS 353382 (parent) | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | no conjugate | 2256 |
| ISIS 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$A$_{do'}$-GalNAC$_3$-1$_a$ | 5/10/5 | GalNAc$_3$-1 | 2257 |
| ISIS 664507 | GalNAC$_3$-2$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-2 | 2258 |
| ISIS 661161 | GalNAC$_3$-3$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-3 | 2258 |
| ISIS 666224 | GalNAC$_3$-5$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-5 | 2258 |
| ISIS 666961 | GalNAC$_3$-6$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-6 | 2258 |

TABLE 42-continued

Modified ASO targeting SRB-1

| ASO | Sequence (5' to 3') | Motif | Conjugate | SEQ ID No. |
|---|---|---|---|---|
| ISIS 666981 | GalNAc$_3$-7$_{a-o'}$A$_{do}$G$_{es}$$^m$C$_{es}$ T$_{es}$T$_{es}$$^m$C$_{es}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{es}$$^m$C$_{es}$ $^m$C$_{es}$T$_{es}$T$_e$ | 5/10/5 | GalNAc$_3$-7 | 2258 |
| ISIS 666881 | GalNAc$_3$-10$_{a-o'}$A$_{do}$G$_{es}$ $^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{es}$T$_e$ | 5/10/5 | GalNAc$_3$-10 | 2258 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9. The structure of GalNAc$_3$-2$_a$ was shown previously in Example 37. The structure of GalNAc$_3$-3$_a$ was shown previously in Example 39. The structure of GalNAc$_3$-5$_a$ was shown previously in Example 49. The structure of GalNAc$_3$-6$_a$ was shown previously in Example 51. The structure of GalNAc$_3$-7$_a$ was shown previously in Example 48. The structure of GalNAc$_3$-10$_a$ was shown previously in Example 46.

Treatment

Six week old male Balb/c mice (Jackson Laboratory, Bar Harbor, Me.) were injected subcutaneously once at the dosage shown below with ISIS 353382, 655861, 664507, 661161, 666224, 666961, 666981, 666881 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 43, treatment with antisense oligonucleotides lowered SRB-1 mRNA levels in a dose-dependent manner. Indeed, the conjugated antisense oligonucleotides showed substantial improvement in potency compared to the unconjugated antisense oligonucleotide (ISIS 353382). The 5' conjugated antisense oligonucleotides showed a slight increase in potency compared to the 3' conjugated antisense oligonucleotide.

TABLE 43

| ISIS No. | Dosage (mg/kg) | SRB-1 mRNA (% Saline) | Conjugate |
|---|---|---|---|
| Saline | n/a | 100.0 | |
| 353382 | 3 | 96.0 | none |
| | 10 | 73.1 | |
| | 30 | 36.1 | |
| 655861 | 0.5 | 99.4 | GalNac$_3$-1 (3') |
| | 1.5 | 81.2 | |
| | 5 | 33.9 | |
| | 15 | 15.2 | |
| 664507 | 0.5 | 102.0 | GalNac$_3$-2 (5') |
| | 1.5 | 73.2 | |
| | 5 | 31.3 | |
| | 15 | 10.8 | |
| 661161 | 0.5 | 90.7 | GalNac$_3$-3 (5') |
| | 1.5 | 67.6 | |
| | 5 | 24.3 | |
| | 15 | 11.5 | |
| 666224 | 0.5 | 96.1 | GalNac$_3$-5 (5') |
| | 1.5 | 61.6 | |
| | 5 | 25.6 | |
| | 15 | 11.7 | |
| 666961 | 0.5 | 85.5 | GalNAc$_3$-6 (5') |
| | 1.5 | 56.3 | |
| | 5 | 34.2 | |
| | 15 | 13.1 | |
| 666981 | 0.5 | 84.7 | GalNAc$_3$-7 (5') |
| | 1.5 | 59.9 | |
| | 5 | 24.9 | |
| | 15 | 8.5 | |
| 666881 | 0.5 | 100.0 | GalNAc$_3$-10 (5') |
| | 1.5 | 65.8 | |
| | 5 | 26.0 | |
| | 15 | 13.0 | |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in Table 44 below.

TABLE 44

| ISIS No. | Dosage mg/kg | ALT | AST | Total Bilirubin | BUN | Conjugate |
|---|---|---|---|---|---|---|
| Saline | | 26 | 57 | 0.2 | 27 | |
| 353382 | 3 | 25 | 92 | 0.2 | 27 | none |
| | 10 | 23 | 40 | 0.2 | 25 | |
| | 30 | 29 | 54 | 0.1 | 28 | |
| 655861 | 0.5 | 25 | 71 | 0.2 | 34 | GalNac$_3$-1 (3') |
| | 1.5 | 28 | 60 | 0.2 | 26 | |
| | 5 | 26 | 63 | 0.2 | 28 | |
| | 15 | 25 | 61 | 0.2 | 28 | |
| 664507 | 0.5 | 25 | 62 | 0.2 | 25 | GalNac$_3$-2 (5') |
| | 1.5 | 24 | 49 | 0.2 | 26 | |
| | 5 | 21 | 50 | 0.2 | 26 | |
| | 15 | 59 | 84 | 0.1 | 22 | |
| 661161 | 0.5 | 20 | 42 | 0.2 | 29 | GalNac$_3$-3 (5') |
| | 1.5 g | 37 | 74 | 0.2 | 25 | |
| | 5 g | 28 | 61 | 0.2 | 29 | |
| | 15 | 21 | 41 | 0.2 | 25 | |
| 666224 | 0.5 | 34 | 48 | 0.2 | 21 | GalNac$_3$-5 (5') |
| | 1.5 | 23 | 46 | 0.2 | 26 | |
| | 5 | 24 | 47 | 0.2 | 23 | |
| | 15 | 32 | 49 | 0.1 | 26 | |
| 666961 | 0.5 | 17 | 63 | 0.2 | 26 | GalNAc$_3$-6 (5') |
| | 1.5 | 23 | 68 | 0.2 | 26 | |
| | 5 | 25 | 66 | 0.2 | 26 | |
| | 15 | 29 | 107 | 0.2 | 28 | |
| 666981 | 0.5 | 24 | 48 | 0.2 | 26 | GalNAc$_3$-7 (5') |
| | 1.5 | 30 | 55 | 0.2 | 24 | |
| | 5 | 46 | 74 | 0.1 | 24 | |
| | 15 | 29 | 58 | 0.1 | 26 | |
| 666881 | 0.5 | 20 | 65 | 0.2 | 27 | GalNAc$_3$-10 (5') |
| | 1.5 | 23 | 59 | 0.2 | 24 | |
| | 5 | 45 | 70 | 0.2 | 26 | |
| | 15 | 21 | 57 | 0.2 | 24 | |

Example 57

Duration of Action Study of Oligonucleotides Comprising a 3'-Conjugate Group Targeting ApoC III In Vivo Mice were injected once with the doses indicated below and monitored over the course of 42 days for ApoC-III and plasma triglycerides (Plasma TG) levels. The study was performed using 3 transgenic mice that express human APOC-III in each group.

TABLE 45

Modified ASO targeting ApoC III

| ASO | Sequence (5' to 3') | Linkages | SEQ ID No. |
|---|---|---|---|
| ISIS 304801 | $A_{es}G_{es}{}^mC_{es}T_{es}T_{es}{}^mC_{ds}T_{ds}T_{ds}G_{ds}T_{ds}$ ${}^mC_{ds}{}^mC_{ds}A_{ds}G_{ds}{}^mC_{ds}T_{es}T_{es}T_{es}A_{es}T_{e}$ | PS | 2248 |
| ISIS 647535 | $A_{es}G_{es}{}^mC_{es}T_{es}T_{es}{}^mC_{ds}T_{ds}T_{ds}G_{ds}T_{ds}$ ${}^mC_{ds}{}^mC_{ds}A_{ds}G_{ds}{}^mC_{ds}T_{es}T_{es}T_{es}A_{es}T_{eo}$ $A_{do'}$-GalNAC$_3$-1$_a$ | PS | 2249 |
| ISIS 647536 | $A_{es}G_{eo}{}^mC_{eo}T_{eo}T_{eo}{}^mC_{ds}T_{ds}T_{ds}G_{ds}T_{ds}$ ${}^mC_{ds}{}^mC_{ds}A_{ds}G_{ds}{}^mC_{ds}T_{eo}T_{eo}T_{es}A_{es}T_{eo}$ $A_{do'}$-GalNAC$_3$-1$_a$ | PO/PS | 2249 |

Capital letters indicate the nucleobase for each nucleoside and $^mC$ indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9.

TABLE 46

ApoC III mRNA (% Saline on Day 1) and Plasma TG Levels (% Saline on Day 1)

| ASO | Dose | Target | Day 3 | Day 7 | Day 14 | Day 35 | Day 42 |
|---|---|---|---|---|---|---|---|
| Saline | 0 mg/kg | ApoC-III | 98 | 100 | 100 | 95 | 116 |
| ISIS 304801 | 30 mg/kg | ApoC-III | 28 | 30 | 41 | 65 | 74 |
| ISIS 647535 | 10 mg/kg | ApoC-III | 16 | 19 | 25 | 74 | 94 |
| ISIS 647536 | 10 mg/kg | ApoC-III | 18 | 16 | 17 | 35 | 51 |
| Saline | 0 mg/kg | Plasma TG | 121 | 130 | 123 | 105 | 109 |
| ISIS 304801 | 30 mg/kg | Plasma TG | 34 | 37 | 50 | 69 | 69 |
| ISIS 647535 | 10 mg/kg | Plasma TG | 18 | 14 | 24 | 18 | 71 |
| ISIS 647536 | 10 mg/kg | Plasma TG | 21 | 19 | 15 | 32 | 35 |

As can be seen in the table above the duration of action increased with addition of the 3'-conjugate group compared to the unconjugated oligonucleotide. There was a further increase in the duration of action for the conjugated mixed PO/PS oligonucleotide 647536 as compared to the conjugated full PS oligonucleotide 647535.

Example 58

Dose-dependent Study of Oligonucleotides Comprising a 3'-Conjugate Group (Comparison of GalNAc$_3$-1 and GalNAc$_4$-11) Targeting SRB-1 In Vivo The oligonucleotides listed below were tested in a dose-dependent study for antisense inhibition of SRB-1 in mice. Unconjugated ISIS 440762 was included as an unconjugated standard. Each of the conjugate groups were attached at the 3' terminus of the respective oligonucleotide by a phosphodiester linked 2'-deoxyadenosine nucleoside cleavable moiety.

The structure of GalNAc$_3$-1$_a$ was shown previously in Example 9. The structure of GalNAc$_3$-11$_a$ was shown previously in Example 50.

Treatment

Six week old male Balb/c mice (Jackson Laboratory, Bar Harbor, Me.) were injected subcutaneously once at the dosage shown below with ISIS 440762, 651900, 663748 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 47, treatment with antisense oligonucleotides lowered SRB-1 mRNA levels in a dose-dependent manner. The antisense oligonucleotides comprising the phosphodiester linked GalNAc$_3$-1 and GalNAc$_4$-11 conjugates at the 3' terminus (ISIS 651900 and ISIS 663748) showed substantial improvement in potency compared to the unconjugated antisense oligonucleotide (ISIS 440762). The two conjugated oligonucleotides, GalNAc$_3$-1 and GalNAc$_4$-11, were equipotent.

TABLE 47

Modified ASO targeting SRB-1

| ASO | Sequence (5' to 3') | Dose mg/kg | % Saline control | SEQ ID No. |
|---|---|---|---|---|
| Saline | | | 100 | |
| ISIS 440762 | $T_{ks}{}^mC_{ks}A_{ds}G_{ds}T_{ds}{}^mC_{ds}A_{ds}$ $T_{ds}G_{ds}A_{ds}{}^mC_{ds}T_{ds}T_{ks}{}^mC_{k}$ | 0.6 2 6 | 73.45 59.66 23.50 | 2250 |
| ISIS 651900 | $T_{ks}{}^mC_{ks}A_{ds}G_{ds}T_{ds}{}^mC_{ds}A_{ds}$ $T_{ds}G_{ds}A_{ds}{}^mC_{ds}T_{ds}T_{ks}{}^mC_{ko}$ $A_{do'}$-GalNAC$_3$-1$_a$ | 0.2 0.6 2 6 | 62.75 29.14 8.61 5.62 | 2251 |

TABLE 47-continued

Modified ASO targeting SRB-1

| ASO | Sequence (5' to 3') | Dose mg/kg | % Saline control | SEQ ID No. |
|---|---|---|---|---|
| ISIS 663748 | $T_{ks}{}^mC_{ks}A_{ds}G_{ds}T_{ds}{}^mC_{ds}A_{ds}$ $T_{ds}G_{ds}A_{ds}{}^mC_{ds}T_{ds}T_{ks}{}^mC_{ko}$ $A_{do'}$-GalNAC$_4$-11$_a$ | 0.2<br>0.6<br>2<br>6 | 63.99<br>33.53<br>7.58<br>5.52 | 2251 |

Capital letters indicate the nucleobase for each nucleoside and $^mC$ indicates a 5-methyl cytosine. Subscripts: "e" indicates a 2'-MOE modified nucleoside; "k" indicates 6'-(S)—CH$_3$ bicyclic nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(═O)(OH)—. Conjugate groups are in bold.

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in Table 48 below.

TABLE 48

| ISIS No. | Dosage mg/kg | ALT | AST | Total Bilirubin | BUN | Conjugate |
|---|---|---|---|---|---|---|
| Saline | | 30 | 76 | 0.2 | 40 | |
| 440762 | 0.60 | 32 | 70 | 0.1 | 35 | none |
| | 2 | 26 | 57 | 0.1 | 35 | |
| | 6 | 31 | 48 | 0.1 | 39 | |
| 651900 | 0.2 | 32 | 115 | 0.2 | 39 | GalNac$_3$-1 (3') |
| | 0.6 | 33 | 61 | 0.1 | 35 | |
| | 2 | 30 | 50 | 0.1 | 37 | |
| | 6 | 34 | 52 | 0.1 | 36 | |
| 663748 | 0.2 | 28 | 56 | 0.2 | 36 | GalNac$_4$-11 (3') |
| | 0.6 | 34 | 60 | 0.1 | 35 | |
| | 2 | 44 | 62 | 0.1 | 36 | |
| | 6 | 38 | 71 | 0.1 | 33 | |

Example 59

Effects of GalNAc$_3$-1 Conjugated ASOs Targeting FXI In Vivo

The oligonucleotides listed below were tested in a multiple dose study for antisense inhibition of FXI in mice. ISIS 404071 was included as an unconjugated standard. Each of the conjugate groups was attached at the 3' terminus of the respective oligonucleotide by a phosphodiester linked 2'-deoxyadenosine nucleoside cleavable moiety.

TABLE 49

Modified ASOs targeting FXI

| ASO | Sequence (5' to 3') | Linkages | SEQ ID No. |
|---|---|---|---|
| ISIS 404071 | $T_{es}G_{es}G_{es}T_{es}A_{es}A_{ds}T_{ds}{}^mC_{ds}{}^mC_{ds}$ $A_{ds}{}^mC_{ds}T_{ds}T_{ds}T_{ds}{}^mC_{ds}A_{es}G_{es}A_{es}$ $G_{es}G_e$ | PS | 2259 |

TABLE 49-continued

Modified ASOs targeting FXI

| ASO | Sequence (5' to 3') | Linkages | SEQ ID No. |
|---|---|---|---|
| ISIS 656172 | $T_{es}G_{es}G_{es}T_{es}A_{es}A_{ds}T_{ds}{}^mC_{ds}{}^mC_{ds}$ $A_{ds}{}^mC_{ds}T_{ds}T_{ds}T_{ds}{}^mC_{ds}A_{es}G_{es}A_{es}$ $G_{es}G_{eo}A_{do}$-GalNAc$_3$-1$_a$ | PS | 2260 |
| ISIS 656173 | $T_{es}G_{eo}G_{eo}T_{eo}A_{eo}A_{ds}T_{ds}{}^mC_{ds}{}^mC_{ds}$ $A_{ds}{}^mC_{ds}T_{ds}T_{ds}T_{ds}{}^mC_{ds}A_{eo}G_{eo}A_{es}$ $G_{es}G_{eo}A_{do'}$-GalNAc$_3$-1$_a$ | PO/PS | 2260 |

Capital letters indicate the nucleobase for each nucleoside and $^mC$ indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(═O)(OH)—. Conjugate groups are in bold.

The structure of GalNAc$_3$-1$_a$ as shown previously in Example 9.

Treatment

Six week old male Balb/c mice (Jackson Laboratory, Bar Harbor, Me.) were injected subcutaneously twice a week for 3 weeks at the dosage shown below with ISIS 404071, 656172, 656173 or with PBS treated control. Each treatment group consisted of 4 animals. The mice were sacrificed 72 hours following the final administration to determine the liver FXI mRNA levels using real-time PCR and RIBOGREEN® RNA quantification reagent (Molecular Probes, Inc. Eugene, Oreg.) according to standard protocols. Plasma FXI protein levels were also measured using ELISA. FXI mRNA levels were determined relative to total RNA (using RIBOGREEN®), prior to normalization to PBS-treated control. The results below are presented as the average percent of FXI mRNA levels for each treatment group. The data was normalized to PBS-treated control and is denoted as "% PBS". The ED$_{50}$s were measured using similar methods as described previously and are presented below.

TABLE 50

Factor XI mRNA (% Saline)

| ASO | Dose mg/kg | % Control | Conjugate | Linkages |
|---|---|---|---|---|
| Saline | | 100 | none | |
| ISIS 404071 | 3<br>10<br>30 | 92<br>40<br>15 | none | PS |
| ISIS 656172 | 0.7<br>2<br>6 | 74<br>33<br>9 | GalNAc$_3$-1 | PS |
| ISIS 656173 | 0.7<br>2<br>6 | 49<br>22<br>1 | GalNAc$_3$-1 | PO/PS |

As illustrated in Table 50, treatment with antisense oligonucleotides lowered FXI mRNA levels in a dose-dependent manner. The oligonucleotides comprising a 3'-GalNAc$_3$-1 conjugate group showed substantial improvement in potency compared to the unconjugated antisense oligonucleotide (ISIS 404071). Between the two conjugated oligonucleotides an improvement in potency was further provided by substituting some of the PS linkages with PO (ISIS 656173).

As illustrated in Table 50a, treatment with antisense oligonucleotides lowered FXI protein levels in a dose-dependent manner. The oligonucleotides comprising a 3'-GalNAc$_3$-1 conjugate group showed substantial improvement in potency compared to the unconjugated antisense oligonucleotide (ISIS 404071). Between the two conjugated oligonucleotides an improvement in potency was further provided by substituting some of the PS linkages with PO (ISIS 656173).

TABLE 50a

Factor XI protein (% Saline)

| ASO | Dose mg/kg | Protein (% Control) | Conjugate | Linkages |
|---|---|---|---|---|
| Saline | | 100 | none | |
| ISIS 404071 | 3 | 127 | none | PS |
| | 10 | 32 | | |
| | 30 | 3 | | |
| ISIS 656172 | 0.7 | 70 | GalNAc$_3$-1 | PS |
| | 2 | 23 | | |
| | 6 | 1 | | |
| ISIS 656173 | 0.7 | 45 | GalNAc$_3$-1 | PO/PS |
| | 2 | 6 | | |
| | 6 | 0 | | |

Liver transaminase levels, alanine aminotransferase (ALT) and aspartate aminotransferase (AST), in serum were measured relative to saline injected mice using standard protocols. Total bilirubin, total albumin, CRE and BUN were also evaluated. The change in body weights was evaluated with no significant change from the saline group. ALTs, ASTs, total bilirubin and BUN values are shown in the table below.

TABLE 51

| ISIS No. | Dosage mg/kg | ALT | AST | Total Albumin | Total Bilirubin | CRE | BUN | Conjugate |
|---|---|---|---|---|---|---|---|---|
| Saline | | 71.8 | 84.0 | 3.1 | 0.2 | 0.2 | 22.9 | |
| 404071 | 3 | 152.8 | 176.0 | 3.1 | 0.3 | 0.2 | 23.0 | none |
| | 10 | 73.3 | 121.5 | 3.0 | 0.2 | 0.2 | 21.4 | |
| | 30 | 82.5 | 92.3 | 3.0 | 0.2 | 0.2 | 23.0 | |
| 656172 | 0.7 | 62.5 | 111.5 | 3.1 | 0.2 | 0.2 | 23.8 | GalNac$_3$-1 (3') |
| | 2 | 33.0 | 51.8 | 2.9 | 0.2 | 0.2 | 22.0 | |
| | 6 | 65.0 | 71.5 | 3.2 | 0.2 | 0.2 | 23.9 | |
| 656173 | 0.7 | 54.8 | 90.5 | 3.0 | 0.2 | 0.2 | 24.9 | GalNac$_3$-1 (3') |
| | 2 | 85.8 | 71.5 | 3.2 | 0.2 | 0.2 | 21.0 | |
| | 6 | 114.0 | 101.8 | 3.3 | 0.2 | 0.2 | 22.7 | |

Example 60

Effects of Conjugated ASOs Targeting SRB-1 In Vitro

The oligonucleotides listed below were tested in a multiple dose study for antisense inhibition of SRB-1 in primary mouse hepatocytes. ISIS 353382 was included as an unconjugated standard. Each of the conjugate groups were attached at the 3' or 5' terminus of the respective oligonucleotide by a phosphodiester linked 2'-deoxyadenosine nucleoside cleavable moiety.

TABLE 52

Modified ASO targeting SRB-1

| ASO | Sequence (5' to 3') | Motif | Conjugate | SEQ ID No. |
|---|---|---|---|---|
| ISIS 353382 | $G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{e}$ | 5/10/5 | none | 2256 |
| ISIS 655861 | $G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{eo}A_{do}, \text{-GalNAc}_3\text{-1}_a$ | 5/10/5 | GalNAc$_3$-1 | 2257 |
| ISIS 655862 | $G_{es}{}^mC_{eo}T_{eo}T_{eo}{}^mC_{eo}A_{ds}G_{ds}T_{ds}{}^mC_{ds}A_{ds}T_{ds}G_{ds}A_{ds}{}^mC_{ds}T_{ds}T_{eo}\text{m}C_{eo}{}^mC_{es}T_{es}T_{eo}A_{do}, \text{-GalNAc}_3\text{-1}_a$ | 5/10/5 | GalNAc$_3$-1 | 2257 |
| ISIS 661161 | GalNAc$_3$-3$_{a-o}$,$A_{do}G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc$_3$-3 | 2258 |
| ISIS 665001 | GalNAc$_3$-8$_{a-o}$,$A_{do}G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc$_3$-8 | 2258 |
| ISIS 664078 | $G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{eo}A_{do}, \text{-GalNAc}_3\text{-9}_a$ | 5/10/5 | GalNAc$_3$-9 | 2257 |
| ISIS 666961 | GalNAc$_3$-6$_{a-o}$,$A_{do}G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc$_3$-6 | 2258 |
| ISIS 664507 | GalNAc$_3$-2$_{a-o}$,$A_{do}G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc$_3$-2 | 2258 |
| ISIS 666881 | GalNAc$_3$-10$_{a-o}$,$A_{do}G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc$_3$-10 | 2258 |
| ISIS 666224 | GalNAc$_3$-5$_{a-o}$,$A_{do}G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc$_3$-5 | 2258 |
| ISIS 666981 | GalNAc$_3$-7$_{a-o}$,$A_{do}G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_{e}$ | 5/10/5 | GalNAc$_3$-7 | 2258 |

Capital letters indicate the nucleobase for each nucleoside and $^mC$ indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9. The structure of GalNAc$_3$-3a was shown previously in Example 39. The structure of GalNAc$_3$-8a was shown previously in Example 47. The structure of GalNAc$_3$-9a was shown previously in Example 52. The structure of GalNAc$_3$-6a was shown previously in Example 51. The structure of GalNAc$_3$-2a was shown previously in Example 37. The structure of GalNAc$_3$-10a was shown previously in Example 46. The structure of GalNAc$_3$-5a was shown previously in Example 49. The structure of GalNAc$_3$-7a was shown previously in Example 48.

Treatment

The oligonucleotides listed above were tested in vitro in primary mouse hepatocyte cells plated at a density of 25,000 cells per well and treated with 0.03, 0.08, 0.24, 0.74, 2.22, 6.67 or 20 nM modified oligonucleotide. After a treatment period of approximately 16 hours, RNA was isolated from the cells and mRNA levels were measured by quantitative real-time PCR and the SRB-1 mRNA levels were adjusted according to total RNA content, as measured by RIBOGREEN®.

The IC$_{50}$ was calculated using standard methods and the results are presented in Table 53. The results show that, under free uptake conditions in which no reagents or electroporation techniques are used to artificially promote entry of the oligonucleotides into cells, the oligonucleotides comprising a GalNAc conjugate were significantly more potent in hepatocytes than the parent oligonucleotide (ISIS 353382) that does not comprise a GalNAc conjugate.

TABLE 53

| ASO | IC$_{50}$ (nM) | Internucleoside linkages | Conjugate | SEQ ID No. |
|---|---|---|---|---|
| ISIS 353382 | 190$^a$ | PS | none | 2256 |
| ISIS 655861 | 11$^a$ | PS | GalNAc$_3$-1 | 2257 |
| ISIS 655862 | 3 | PO/PS | GalNAc$_3$-1 | 2257 |
| ISIS 661161 | 15$^a$ | PS | GalNAc$_3$-3 | 2258 |
| ISIS 665001 | 20 | PS | GalNAc$_3$-8 | 2258 |
| ISIS 664078 | 55 | PS | GalNAc$_3$-9 | 2257 |
| ISIS 666961 | 22$^a$ | PS | GalNAc$_3$-6 | 2258 |
| ISIS 664507 | 30 | PS | GalNAc$_3$-2 | 2258 |
| ISIS 666881 | 30 | PS | GalNAc$_3$-10 | 2258 |
| ISIS 666224 | 30$^a$ | PS | GalNAc$_3$-5 | 2258 |
| ISIS 666981 | 40 | PS | GalNAc$_3$-7 | 2258 |

$^a$Average of multiple runs.

Example 61

Preparation of Oligomeric Compound 175 Comprising GalNAc$_3$-12

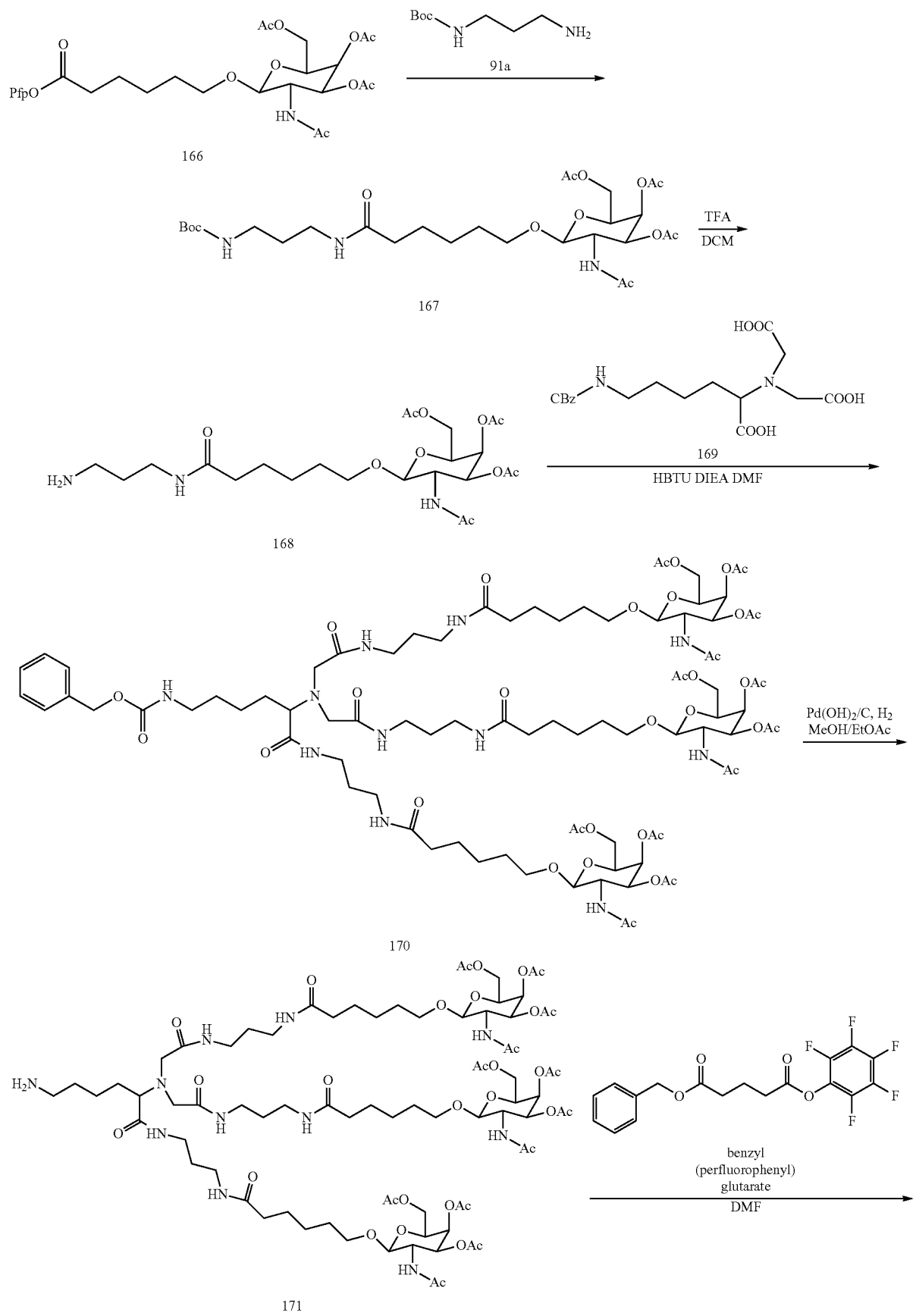

-continued
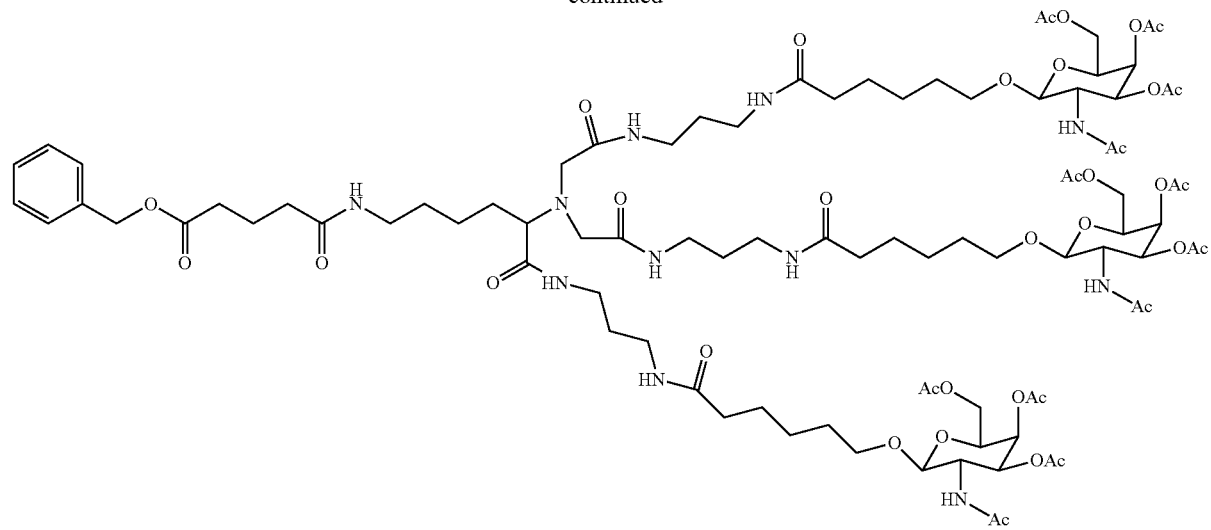
172
172 →(Pd(OH)$_2$/C, H$_2$, MeOH/EtOAc)→
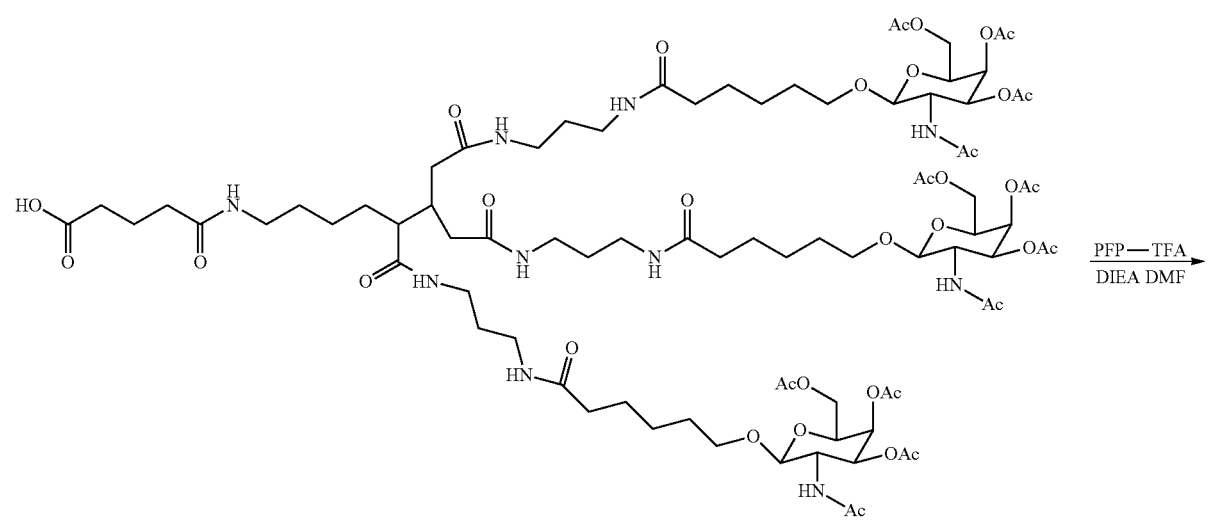
173
→(PFP—TFA, DIEA DMF)→
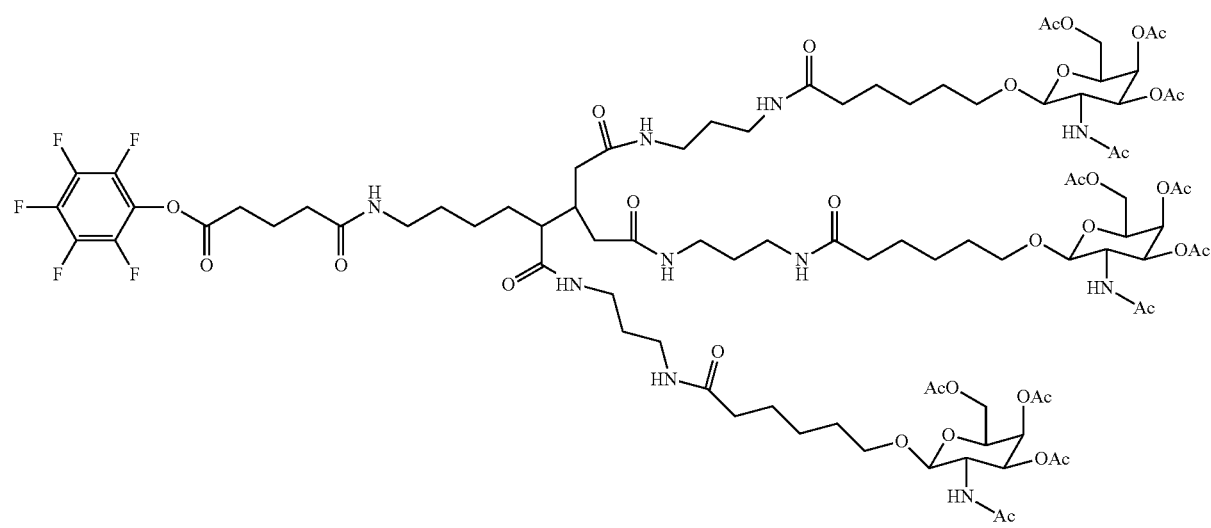
174

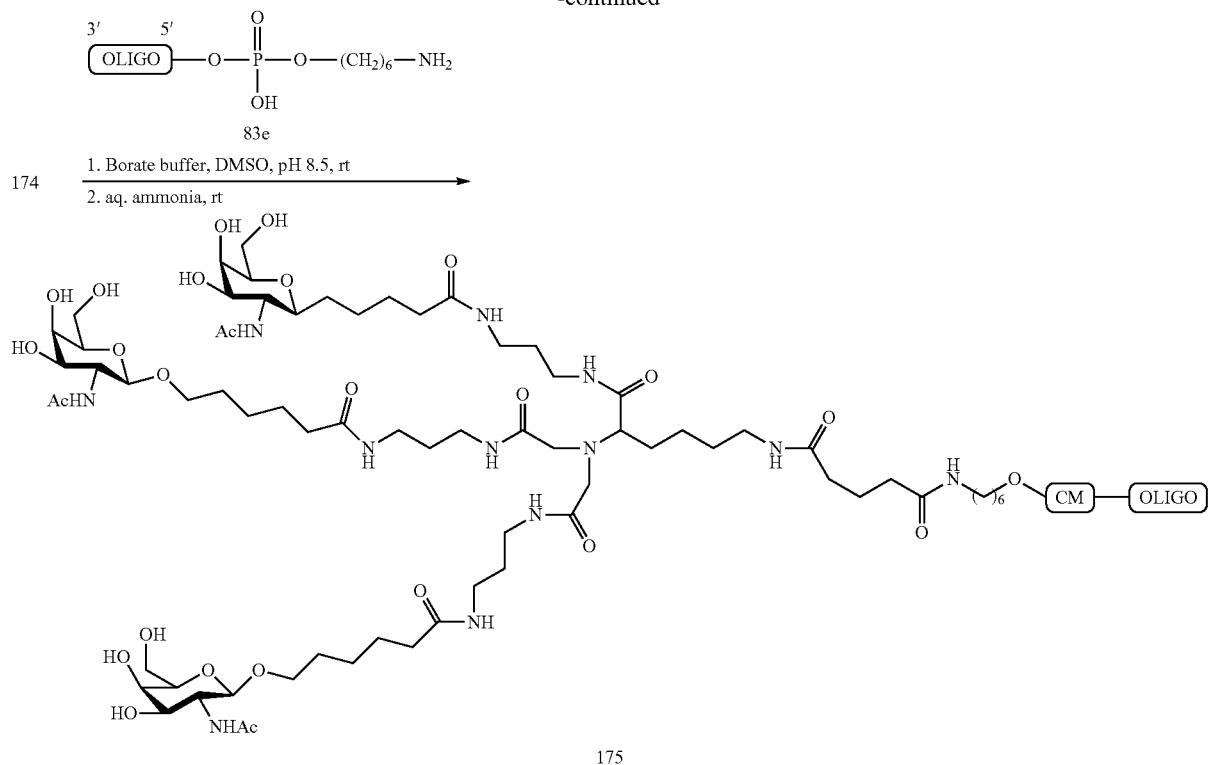

Compound 169 is commercially available. Compound 172 was prepared by addition of benzyl (perfluorophenyl) glutarate to compound 171. The benzyl (perfluorophenyl) glutarate was prepared by adding PFP-TFA and DIEA to 5-(benzyloxy)-5-oxopentanoic acid in DMF. Oligomeric compound 175, comprising a GalNAc$_3$-12 conjugate group, was prepared from compound 174 using the general procedures illustrated in Example 46. The GalNAc$_3$ cluster portion of the conjugate group GalNAc$_3$-12 (GalNAc$_3$-12$_a$) can be combined with any cleavable moiety to provide a variety of conjugate groups. In a certain embodiments, the cleavable moiety is —P(=O)(OH)-A$_d$-P(=O)(OH)—. The structure of GalNAc$_3$-12 (GalNAc$_3$-12$_a$-CM-) is shown below:

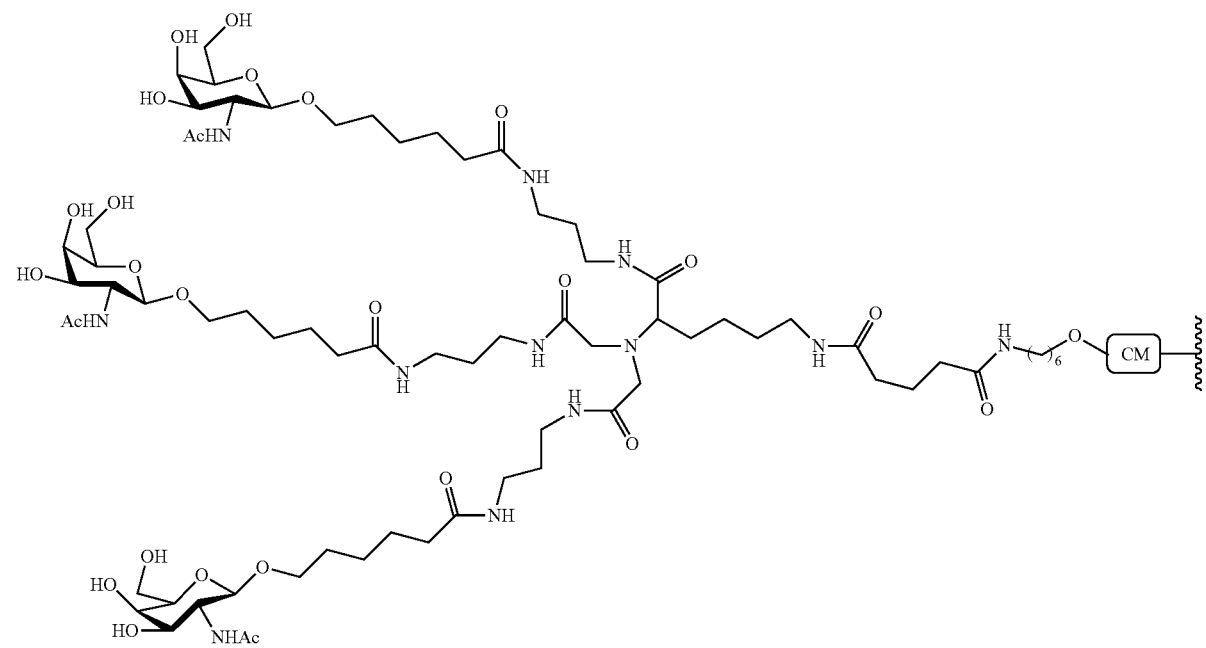

Example 62
Preparation of Oligomeric Compound 180
Comprising GalNAc₃-13
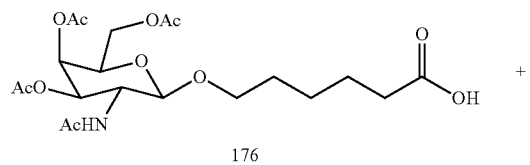
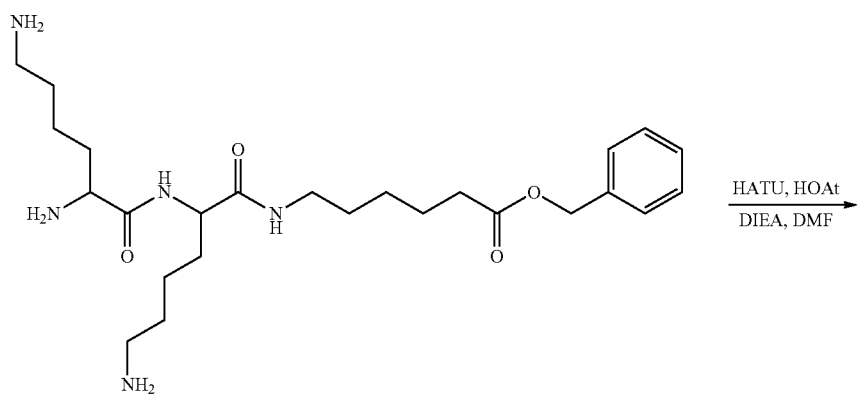
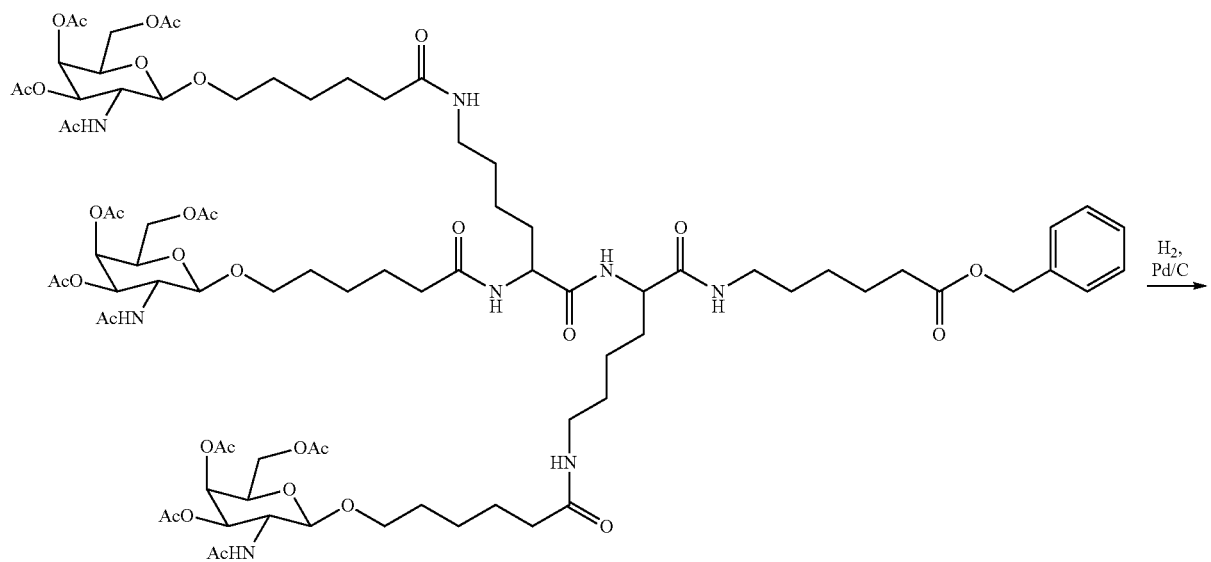

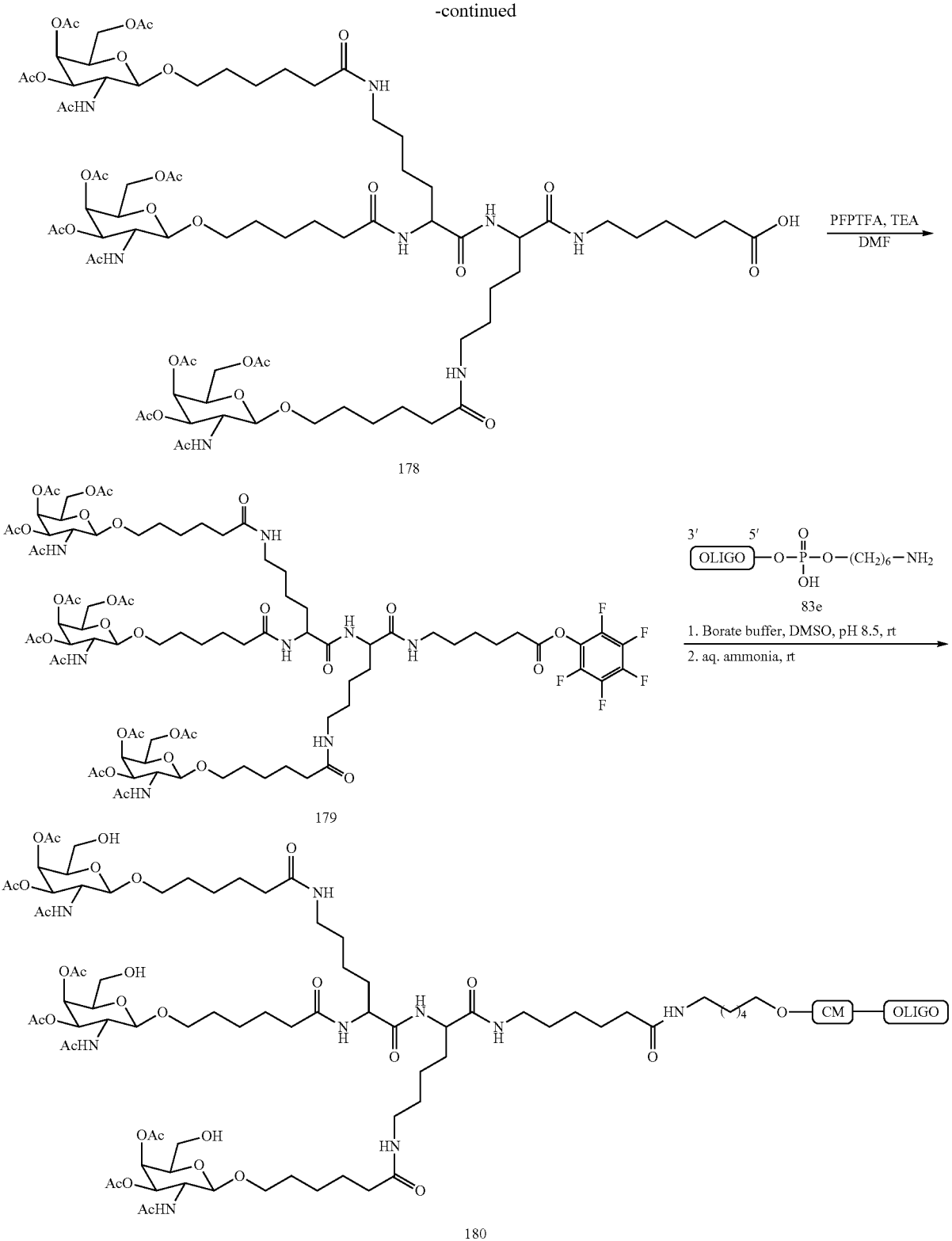

Compound 176 was prepared using the general procedure shown in Example 2. Oligomeric compound 180, comprising a GalNAc₃-13 conjugate group, was prepared from compound 177 using the general procedures illustrated in Example 49. The GalNAc₃ cluster portion of the conjugate group GalNAc₃-13 (GalNAc₃-13$_a$) can be combined with any cleavable moiety to provide a variety of conjugate groups. In a certain embodiments, the cleavable moiety is —P(=O)(OH)-A$_d$-P(=O)(OH)—. The structure of GalNAc₃-13 (GalNAc₃-13$_a$-CM-) is shown below:

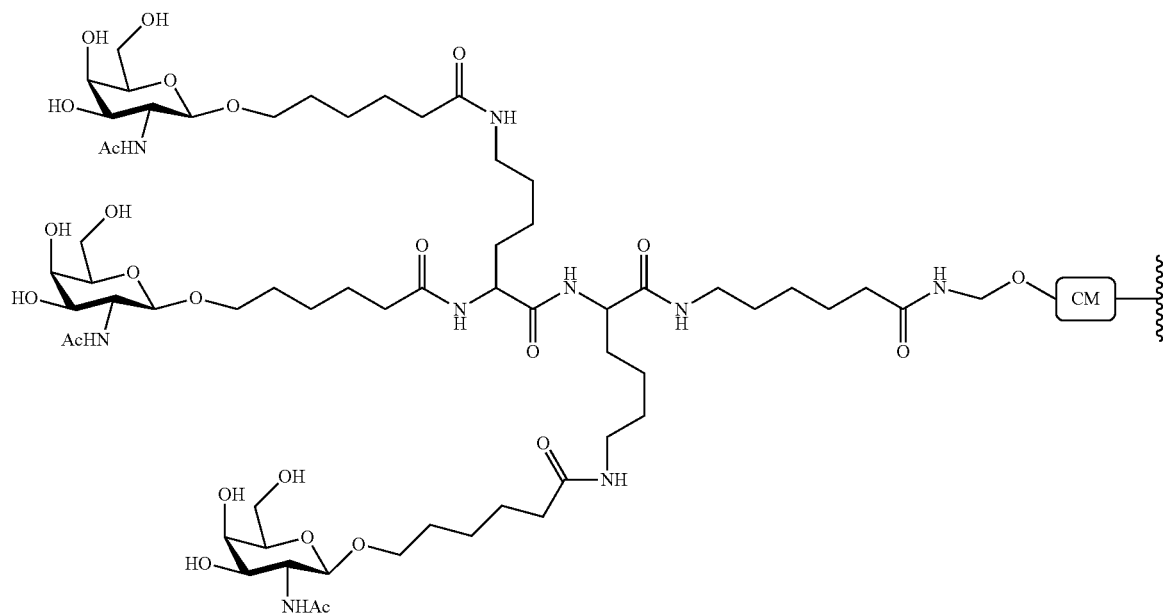
Example 63
Preparation of Oligomeric Compound 188
Comprising GalNAc$_3$-14
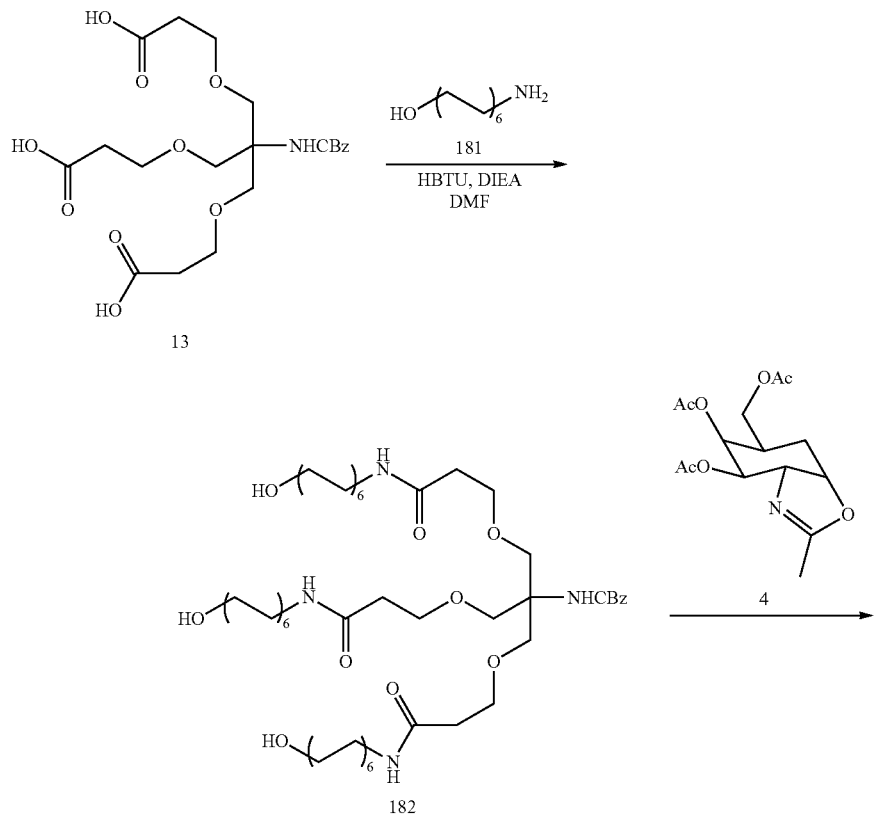

-continued
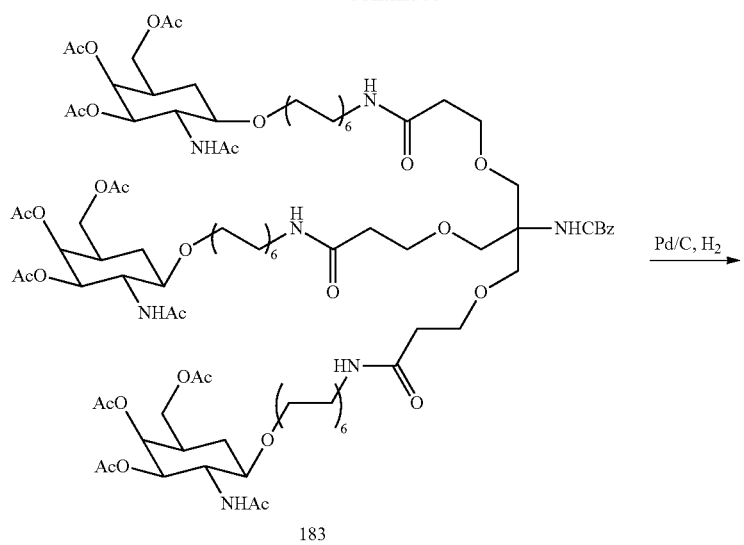
183
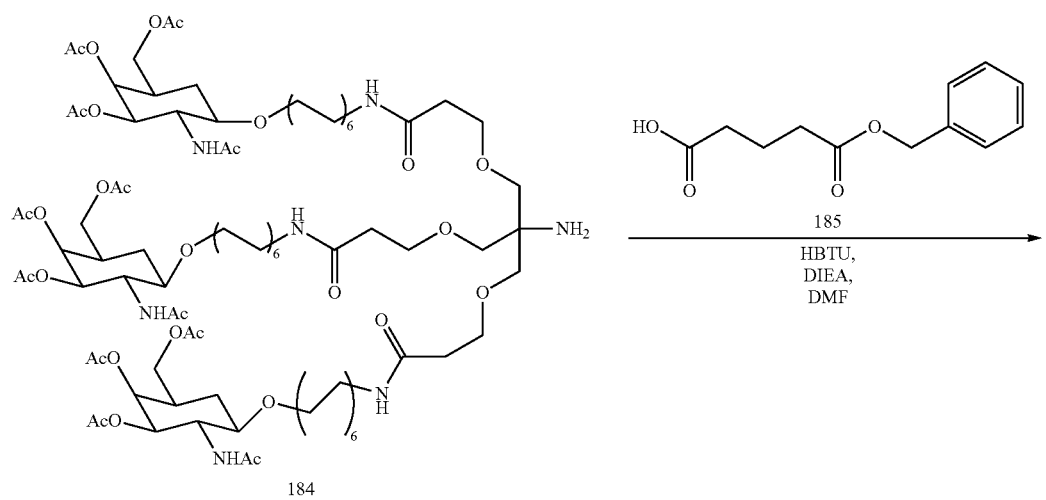
184
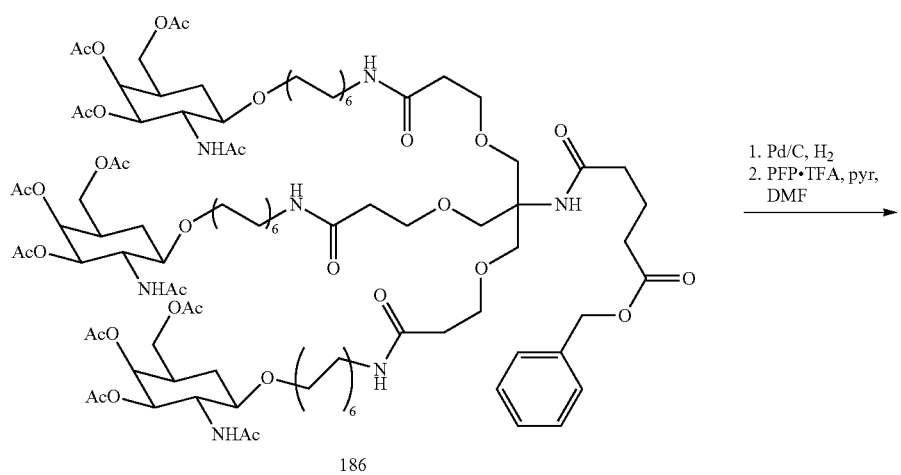
186

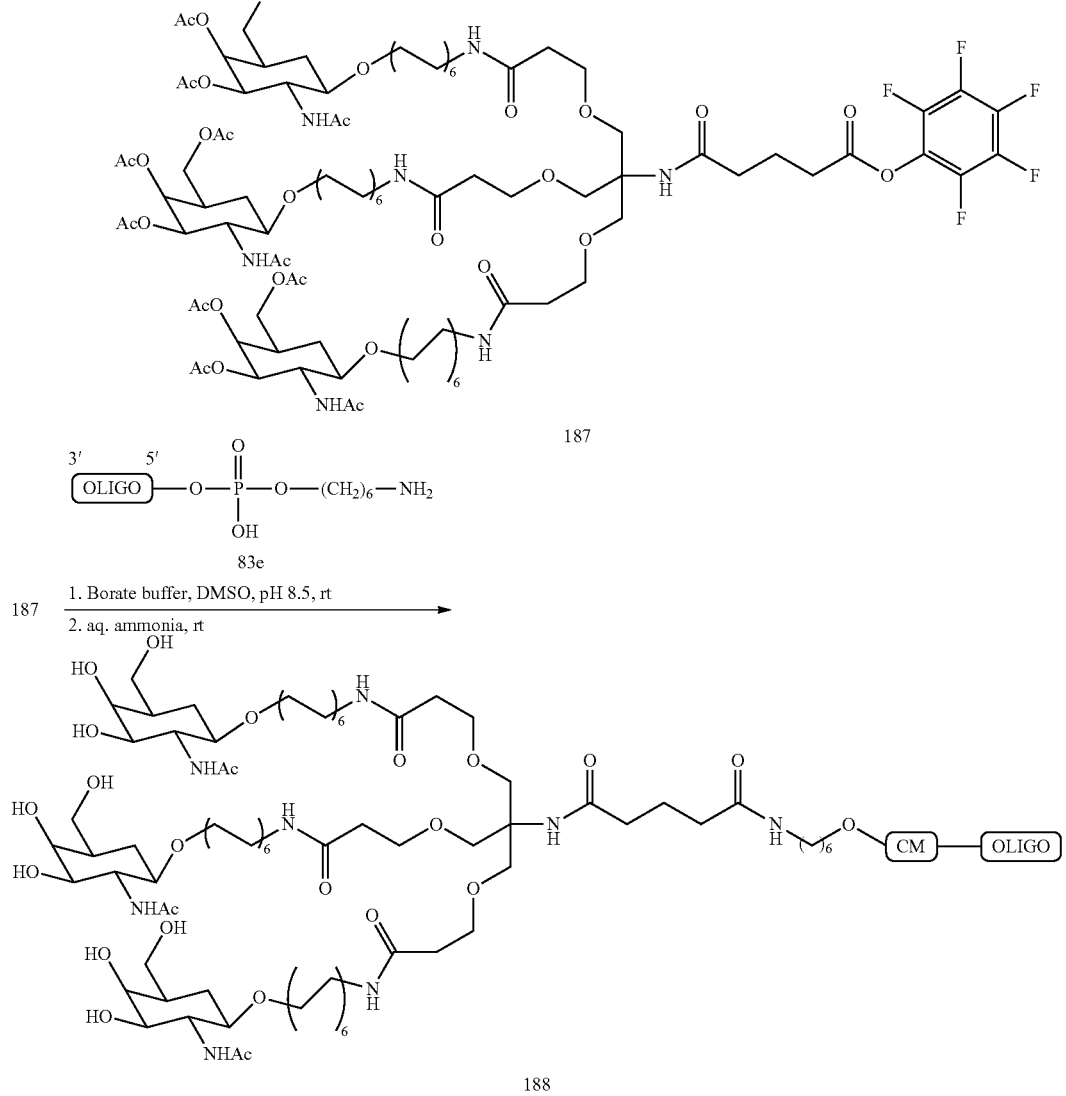

Compounds 181 and 185 are commercially available. Oligomeric compound 188, comprising a GalNAc₃-14 conjugate group, was prepared from compound 187 using the general procedures illustrated in Example 46. The GalNAc₃ cluster portion of the conjugate group GalNAc₃-14 (Gal-NAc₃-14$_a$) can be combined with any cleavable moiety to provide a variety of conjugate groups. In certain embodiments, the cleavable moiety is —P(=O)(OH)-A$_d$-P(=O)(OH)—. The structure of GalNAc₃-14 (GalNAc₃-14$_a$-CM-) is shown below:

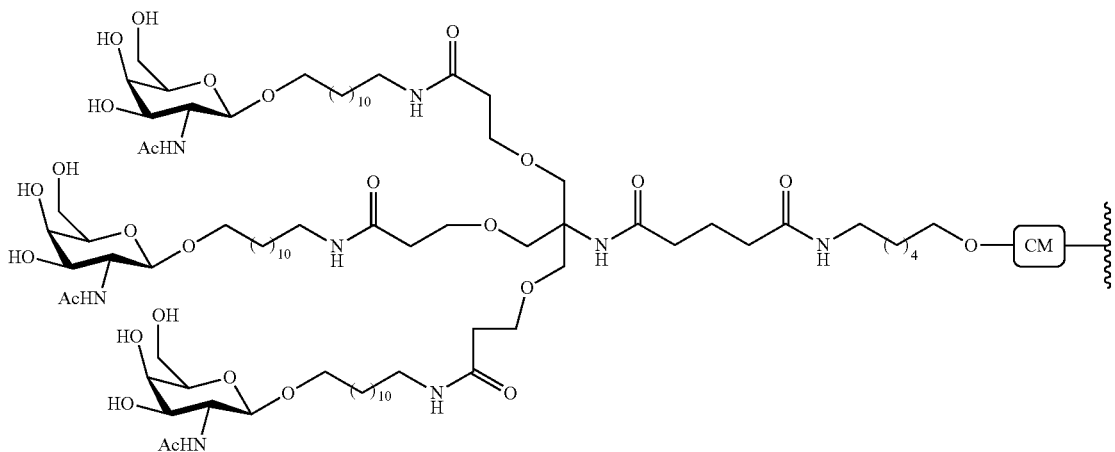

Example 64
Preparation of Oligomeric Compound 197 Comprising GalNAc$_3$-15
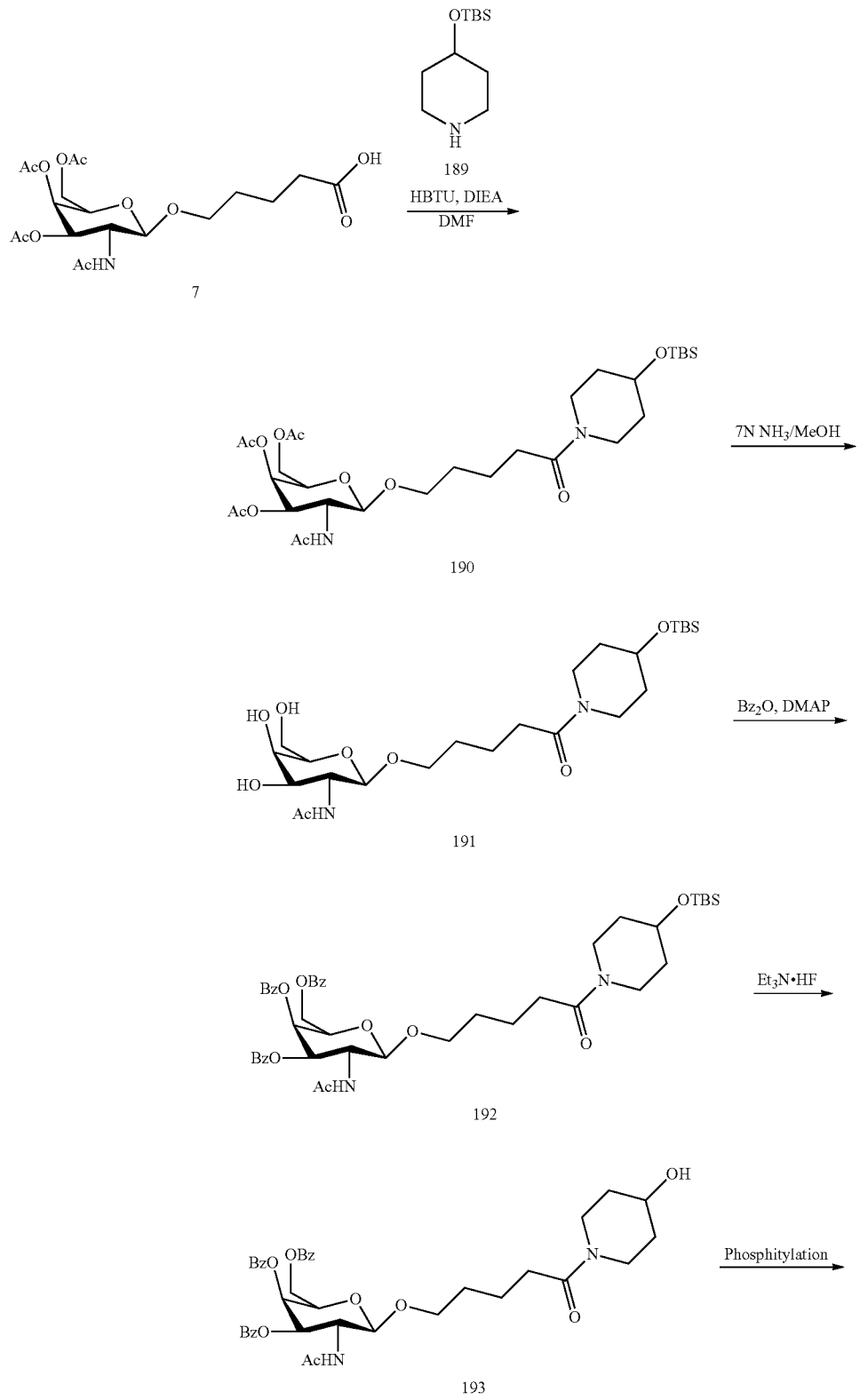

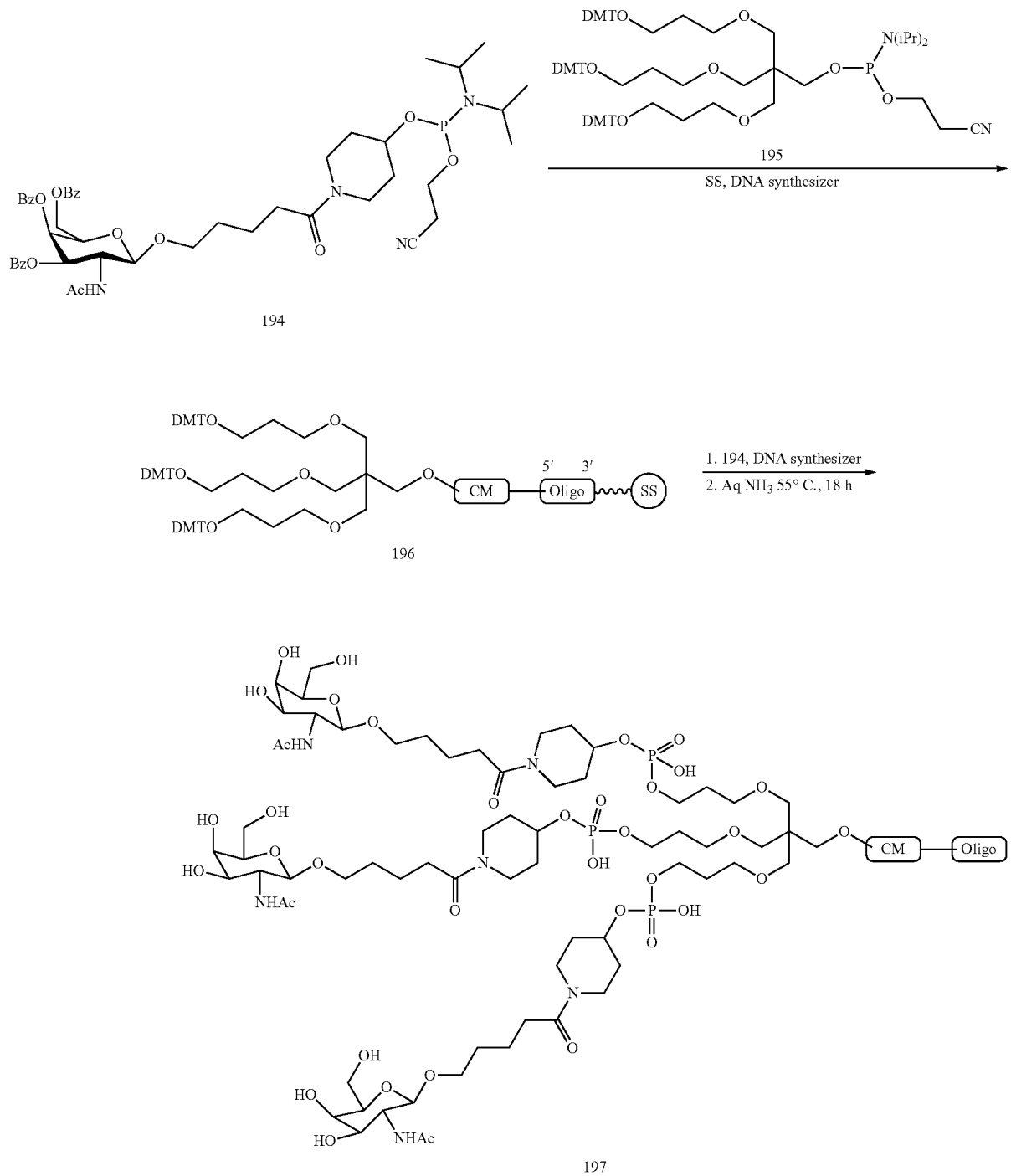

Compound 189 is commercially available. Compound 195 was prepared using the general procedure shown in Example 31. Oligomeric compound 197, comprising a GalNAc$_3$-15 conjugate group, was prepared from compounds 194 and 195 using standard oligonucleotide synthesis procedures. The GalNAc$_3$ cluster portion of the conjugate group GalNAc$_3$-15 (GalNAc$_3$-15$_a$) can be combined with any cleavable moiety to provide a variety of conjugate groups. In certain embodiments, the cleavable moiety is —P(=O)

(OH)-A$_d$-P(=O)(OH)—. The structure of GalNAc$_3$-15 (GalNAc$_3$-15$_a$-CM-) is shown below:

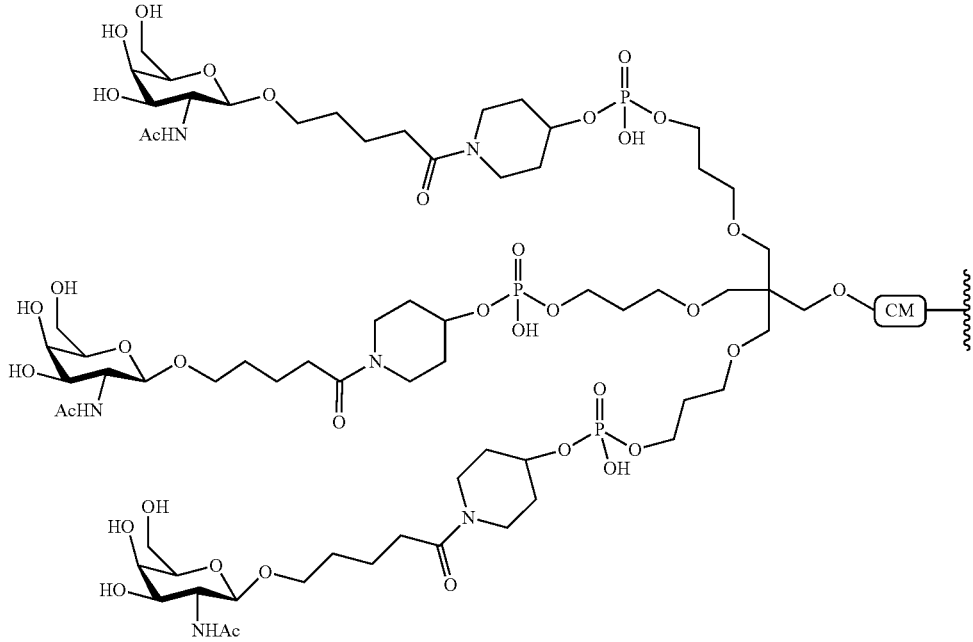

Example 65

Dose-dependent Study of Oligonucleotides Comprising a 5'-Conjugate Group (Comparison of GalNAc$_3$-3, 12, 13, 14, and 15) Targeting SRB-1 In Vivo The oligonucleotides listed below were tested in a dose-dependent study for antisense inhibition of SRB-1 in mice. Unconjugated ISIS 353382 was included as a standard. Each of the GalNAc$_3$ conjugate groups was attached at the 5' terminus of the respective oligonucleotide by a phosphodiester linked 2'-deoxyadenosine nucleoside (cleavable moiety).

TABLE 54

Modified ASOs targeting SRB-1

| ISIS No. | Sequence (5' to 3') | Conjugate | SEQ ID No. |
|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | none | 2256 |
| 661161 | GalNAc$_3$-3$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3 | 2258 |
| 671144 | GalNAc$_3$-12$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-12 | 2258 |
| 670061 | GalNAc$_3$-13$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-13 | 2258 |
| 671261 | GalNAc$_3$-14$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-14 | 2258 |
| 671262 | GalNAc$_3$-15$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-15 | 2258 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-3$_a$ was shown previously in Example 39. The structure of GalNAc$_3$-12a was shown previously in Example 61. The structure of GalNAc$_3$-13a was shown previously in Example 62. The structure of GalNAc$_3$-14a was shown previously in Example 63. The structure of GalNAc$_3$-15a was shown previously in Example 64.

Treatment

Six to eight week old C57bl6 mice (Jackson Laboratory, Bar Harbor, Me.) were injected subcutaneously once or twice at the dosage shown below with ISIS 353382, 661161, 671144, 670061, 671261, 671262, or with saline. Mice that were dosed twice received the second dose three days after the first dose. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 55, treatment with antisense oligonucleotides lowered SRB-1 mRNA levels in a dose-dependent manner. No significant differences in target knockdown were observed between animals that received a single dose and animals that received two doses (see ISIS 353382 dosages 30 and 2×15 mg/kg; and ISIS 661161 dosages 5 and 2×2.5 mg/kg). The antisense oligonucleotides comprising the phosphodiester linked GalNAc$_3$-3, 12, 13, 14, and 15 conjugates showed substantial improvement in potency compared to the unconjugated antisense oligonucleotide (ISIS 335382).

TABLE 55

SRB-1 mRNA (% Saline)

| ISIS No. | Dosage (mg/kg) | SRB-1 mRNA (% Saline) | ED$_{50}$ (mg/kg) | Conjugate |
|---|---|---|---|---|
| Saline | n/a | 100.0 | n/a | n/a |
| 353382 | 3 | 85.0 | 22.4 | none |
|  | 10 | 69.2 |  |  |
|  | 30 | 34.2 |  |  |
|  | 2 × 15 | 36.0 |  |  |
| 661161 | 0.5 | 87.4 | 2.2 | GalNAc$_3$-3 |
|  | 1.5 | 59.0 |  |  |
|  | 5 | 25.6 |  |  |
|  | 2 × 2.5 | 27.5 |  |  |
|  | 15 | 17.4 |  |  |
| 671144 | 0.5 | 101.2 | 3.4 | GalNAc$_3$-12 |
|  | 1.5 | 76.1 |  |  |
|  | 5 | 32.0 |  |  |
|  | 15 | 17.6 |  |  |
| 670061 | 0.5 | 94.8 | 2.1 | GalNAc$_3$-13 |
|  | 1.5 | 57.8 |  |  |
|  | 5 | 20.7 |  |  |
|  | 15 | 13.3 |  |  |
| 671261 | 0.5 | 110.7 | 4.1 | GalNAc$_3$-14 |
|  | 1.5 | 81.9 |  |  |
|  | 5 | 39.8 |  |  |
|  | 15 | 14.1 |  |  |
| 671262 | 0.5 | 109.4 | 9.8 | GalNAc$_3$-15 |
|  | 1.5 | 99.5 |  |  |
|  | 5 | 69.2 |  |  |
|  | 15 | 36.1 |  |  |

Liver transaminase levels, alanine aminotransferase (ALT) and aspartate aminotransferase (AST), in serum were measured relative to saline injected mice using standard protocols. Total bilirubin and BUN were also evaluated. The changes in body weights were evaluated with no significant differences from the saline group (data not shown). ALTs, ASTs, total bilirubin and BUN values are shown in Table 56 below.

TABLE 56

| ISIS No. | Dosage (mg/kg) | ALT (U/L) | AST (U/L) | Total Bilirubin (mg/dL) | BUN (mg/dL) | Conjugate |
|---|---|---|---|---|---|---|
| Saline | n/a | 28 | 60 | 0.1 | 39 | n/a |
| 353382 | 3 | 30 | 77 | 0.2 | 36 | none |
|  | 10 | 25 | 78 | 0.2 | 36 |  |
|  | 30 | 28 | 62 | 0.2 | 35 |  |
|  | 2 × 15 | 22 | 59 | 0.2 | 33 |  |
| 661161 | 0.5 | 39 | 72 | 0.2 | 34 | GalNAc$_3$-3 |
|  | 1.5 | 26 | 50 | 0.2 | 33 |  |
|  | 5 | 41 | 80 | 0.2 | 32 |  |
|  | 2 × 2.5 | 24 | 72 | 0.2 | 28 |  |
|  | 15 | 32 | 69 | 0.2 | 36 |  |

TABLE 56-continued

| ISIS No. | Dosage (mg/kg) | ALT (U/L) | AST (U/L) | Total Bilirubin (mg/dL) | BUN (mg/dL) | Conjugate |
|---|---|---|---|---|---|---|
| 671144 | 0.5 | 25 | 39 | 0.2 | 34 | GalNAc$_3$-12 |
|  | 1.5 | 26 | 55 | 0.2 | 28 |  |
|  | 5 | 48 | 82 | 0.2 | 34 |  |
|  | 15 | 23 | 46 | 0.2 | 32 |  |
| 670061 | 0.5 | 27 | 53 | 0.2 | 33 | GalNAc$_3$-13 |
|  | 1.5 | 24 | 45 | 0.2 | 35 |  |
|  | 5 | 23 | 58 | 0.1 | 34 |  |
|  | 15 | 24 | 72 | 0.1 | 31 |  |
| 671261 | 0.5 | 69 | 99 | 0.1 | 33 | GalNAc$_3$-14 |
|  | 1.5 | 34 | 62 | 0.1 | 33 |  |
|  | 5 | 43 | 73 | 0.1 | 32 |  |
|  | 15 | 32 | 53 | 0.2 | 30 |  |
| 671262 | 0.5 | 24 | 51 | 0.2 | 29 | GalNAc$_3$-15 |
|  | 1.5 | 32 | 62 | 0.1 | 31 |  |
|  | 5 | 30 | 76 | 0.2 | 32 |  |
|  | 15 | 31 | 64 | 0.1 | 32 |  |

Example 66

Effect of Various Cleavable Moieties on Antisense Inhibition In Vivo by Oligonucleotides Targeting SRB-1 Comprising a 5'-GalNAc$_3$ Cluster The oligonucleotides listed below were tested in a dose-dependent study for antisense inhibition of SRB-1 in mice. Each of the GalNAc$_3$ conjugate groups was attached at the 5' terminus oligonucleotide by a phosphodiester linked nucleoside (cleavable moiety (CM)).

TABLE 57

Modified ASOs targeting SRB-1

| ISIS No. | Sequence (5' to 3') | GalNAc$_3$ Cluster | CM | SEQ ID No. |
|---|---|---|---|---|
| 661161 | GalNAc$_3$-3$_{a\text{-}o}$,A$_{do}$G$_{es}$$^m$C$_{es}$T$_{es}$ T$_{es}$$^m$C$_{es}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{es}$$^m$C$_{es}$$^m$C$_{es}$T$_{es}$T$_{e}$ | GalNAc$_3$-3a | A$_d$ | 2258 |
| 670699 | GalNAc$_3$-3$_{a\text{-}o}$,T$_{do}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{eo}$$^m$C$_{eo}$$^m$C$_{es}$T$_{es}$T$_{e}$ | GalNAc$_3$-3a | T$_d$ | 2261 |
| 670700 | GalNAc$_3$-3$_{a\text{-}o}$,A$_{eo}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{eo}$$^m$C$_{eo}$$^m$C$_{es}$T$_{es}$T$_{e}$ | GalNAc$_3$-3a | A$_e$ | 2258 |
| 670701 | GalNAc$_3$-3$_{a\text{-}o}$,T$_{eo}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{eo}$$^m$C$_{eo}$$^m$C$_{es}$T$_{es}$T$_{e}$ | GalNAc$_3$-3a | T$_e$ | 2261 |
| 671165 | GalNAc$_3$-13$_{a\text{-}o}$,A$_{do}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{eo}$$^m$C$_{eo}$$^m$C$_{es}$T$_{es}$T$_{e}$ | GalNAc$_3$-13a | A$_d$ | 2258 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-3$_a$ was shown previously in Example 39. The structure of GalNAc$_3$-13a was shown previously in Example 62.

Treatment

Six to eight week old C57bl6 mice (Jackson Laboratory, Bar Harbor, Me.) were injected subcutaneously once at the dosage shown below with ISIS 661161, 670699, 670700, 670701, 671165, or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 58, treatment with antisense oligonucleotides lowered SRB-1 mRNA levels in a dose-dependent manner. The antisense oligonucleotides comprising various cleavable moieties all showed similar potencies.

TABLE 58

SRB-1 mRNA (% Saline)

| ISIS No. | Dosage (mg/kg) | SRB-1 mRNA (% Saline) | GalNAc$_3$ Cluster | CM |
|---|---|---|---|---|
| Saline | n/a | 100.0 | n/a | n/a |
| 661161 | 0.5 | 87.8 | GalNAc$_3$-3a | A$_d$ |
|  | 1.5 | 61.3 |  |  |
|  | 5 | 33.8 |  |  |
|  | 15 | 14.0 |  |  |
| 670699 | 0.5 | 89.4 | GalNAc$_3$-3a | T$_d$ |
|  | 1.5 | 59.4 |  |  |
|  | 5 | 31.3 |  |  |
|  | 15 | 17.1 |  |  |
| 670700 | 0.5 | 79.0 | GalNAc$_3$-3a | A$_e$ |
|  | 1.5 | 63.3 |  |  |
|  | 5 | 32.8 |  |  |
|  | 15 | 17.9 |  |  |
| 670701 | 0.5 | 79.1 | GalNAc$_3$-3a | T$_e$ |
|  | 1.5 | 59.2 |  |  |
|  | 5 | 35.8 |  |  |
|  | 15 | 17.7 |  |  |
| 671165 | 0.5 | 76.4 | GalNAc$_3$-13a | A$_d$ |
|  | 1.5 | 43.2 |  |  |
|  | 5 | 22.6 |  |  |
|  | 15 | 10.0 |  |  |

Liver transaminase levels, alanine aminotransferase (ALT) and aspartate aminotransferase (AST), in serum were measured relative to saline injected mice using standard protocols. Total bilirubin and BUN were also evaluated. The changes in body weights were evaluated with no significant differences from the saline group (data not shown). ALTs, ASTs, total bilirubin and BUN values are shown in Table 56 below.

TABLE 59

| ISIS No. | Dosage (mg/kg) | ALT (U/L) | AST (U/L) | Total Bilirubin (mg/dL) | BUN (mg/dL) | GalNAc$_3$ Cluster | CM |
|---|---|---|---|---|---|---|---|
| Saline | n/a | 24 | 64 | 0.2 | 31 | n/a | n/a |
| 661161 | 0.5 | 25 | 64 | 0.2 | 31 | GalNAc$_3$-3a | A$_d$ |
|  | 1.5 | 24 | 50 | 0.2 | 32 |  |  |
|  | 5 | 26 | 55 | 0.2 | 28 |  |  |
|  | 15 | 27 | 52 | 0.2 | 31 |  |  |
| 670699 | 0.5 | 42 | 83 | 0.2 | 31 | GalNAc$_3$-3a | T$_d$ |
|  | 1.5 | 33 | 58 | 0.2 | 32 |  |  |
|  | 5 | 26 | 70 | 0.2 | 29 |  |  |
|  | 15 | 25 | 67 | 0.2 | 29 |  |  |

TABLE 59-continued
| ISIS No. | Dosage (mg/kg) | ALT (U/L) | AST (U/L) | Total Bilirubin (mg/dL) | BUN (mg/dL) | GalNAc$_3$ Cluster | CM |
|---|---|---|---|---|---|---|---|
| 670700 | 0.5 | 40 | 74 | 0.2 | 27 | GalNAc$_3$-3a | A$_e$ |
|  | 1.5 | 23 | 62 | 0.2 | 27 |  |  |
|  | 5 | 24 | 49 | 0.2 | 29 |  |  |
|  | 15 | 25 | 87 | 0.1 | 25 |  |  |
| 670701 | 0.5 | 30 | 77 | 0.2 | 27 | GalNAc$_3$-3a | T$_e$ |
|  | 1.5 | 22 | 55 | 0.2 | 30 |  |  |
|  | 5 | 81 | 101 | 0.2 | 25 |  |  |
|  | 15 | 31 | 82 | 0.2 | 24 |  |  |
| 671165 | 0.5 | 44 | 84 | 0.2 | 26 | GalNAc$_3$-13a | A$_d$ |
|  | 1.5 | 47 | 71 | 0.1 | 24 |  |  |
|  | 5 | 33 | 91 | 0.2 | 26 |  |  |
|  | 15 | 33 | 56 | 0.2 | 29 |  |  |
Example 67
Preparation of Oligomeric Compound 199 Comprising GalNAc$_3$-16
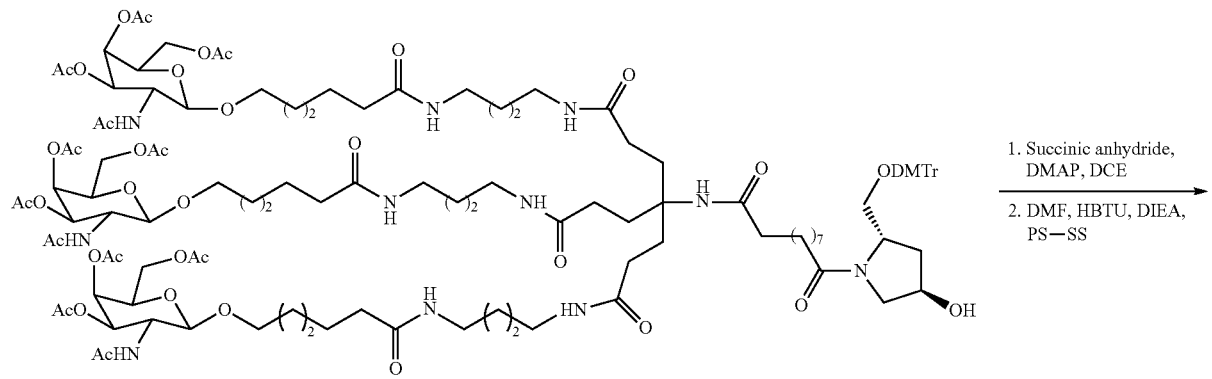
1. Succinic anhydride, DMAP, DCE
2. DMF, HBTU, DIEA, PS—SS
98d
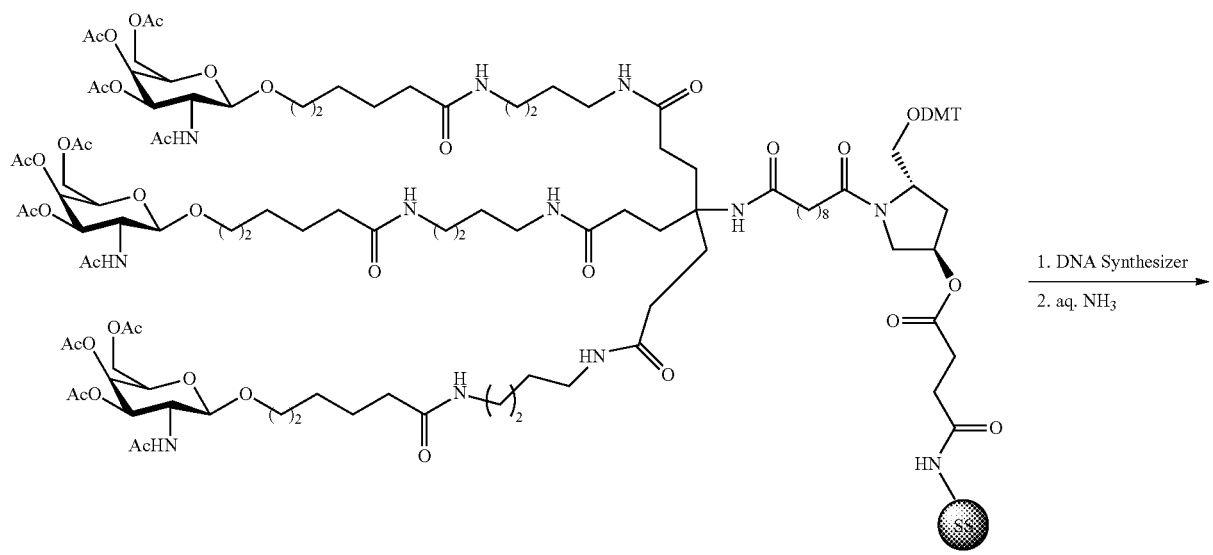
1. DNA Synthesizer
2. aq. NH$_3$

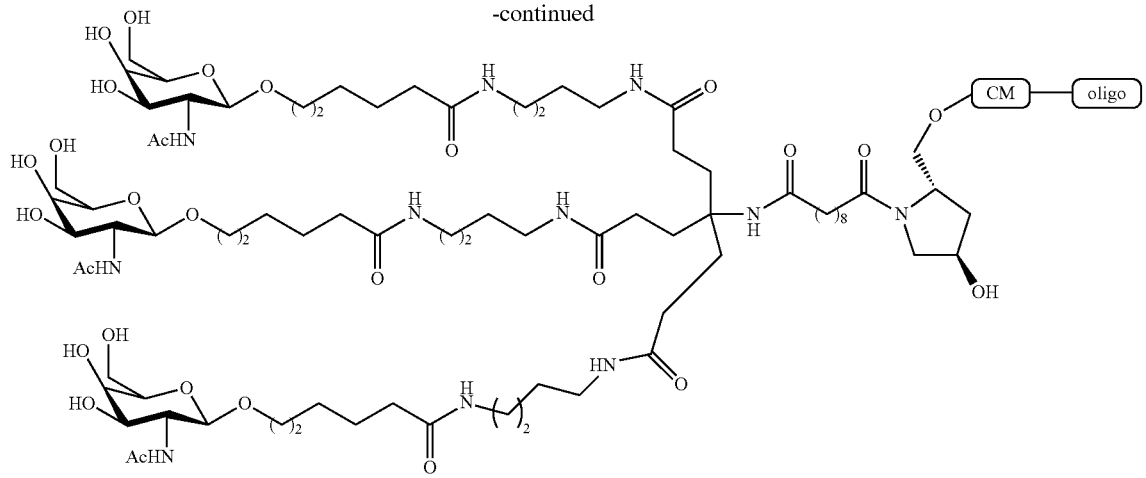

199

Oligomeric compound 199, comprising a GalNAc$_3$-16 conjugate group, is prepared using the general procedures illustrated in Examples 7 and 9. The GalNAc$_3$ cluster portion of the conjugate group GalNAc$_3$-16 (GalNAc$_3$-16$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-16 (GalNAc$_3$-16$_a$-CM-) is shown below:

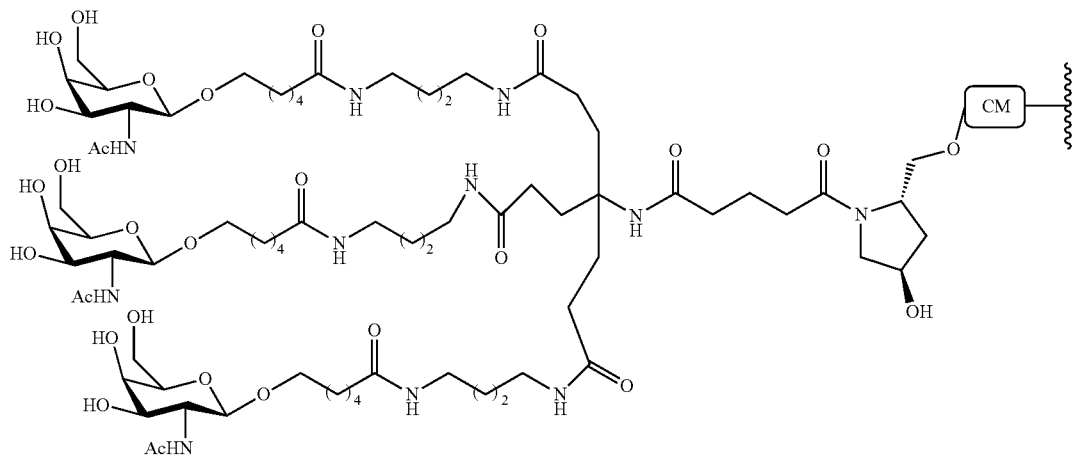

Example 68

Preparation of Oligomeric Compound 200 Comprising GalNAc$_3$-17

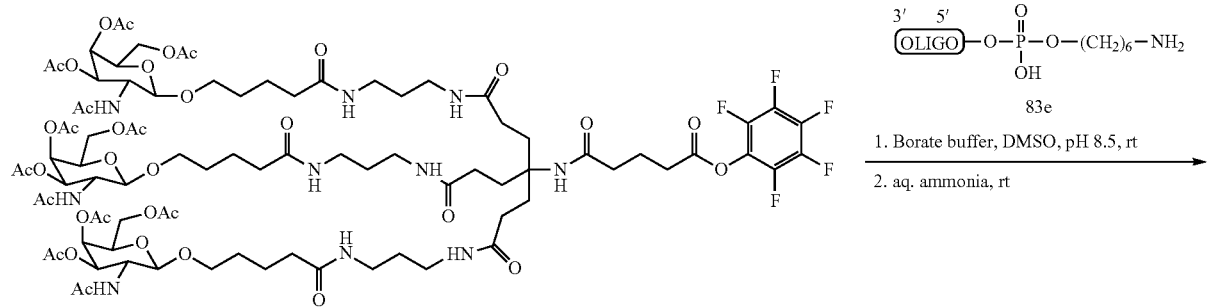

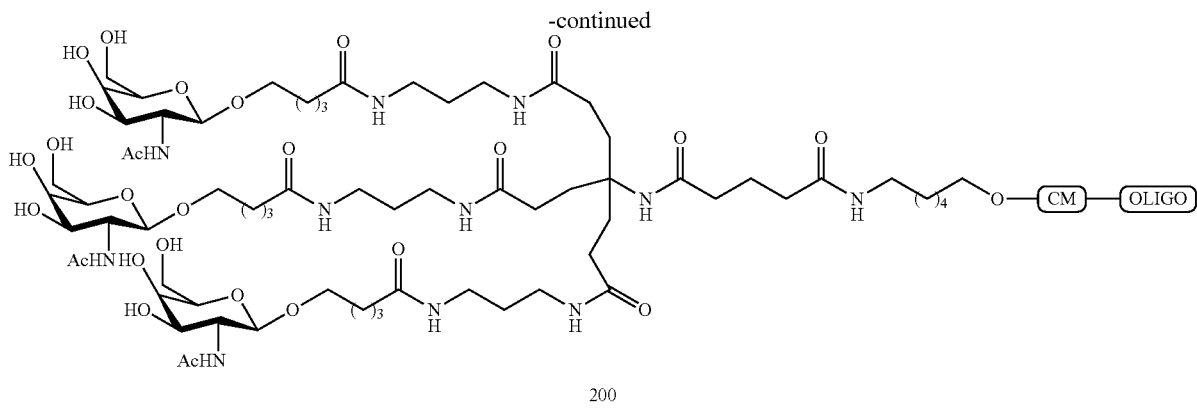

200

Oligomeric compound 200, comprising a GalNAc$_3$-17 conjugate group, was prepared using the general procedures illustrated in Example 46. The GalNAc$_3$ cluster portion of the conjugate group GalNAc$_3$-17 (GalNAc$_3$-17$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-17 (GalNAc$_3$-17$_a$-CM-) is shown below:

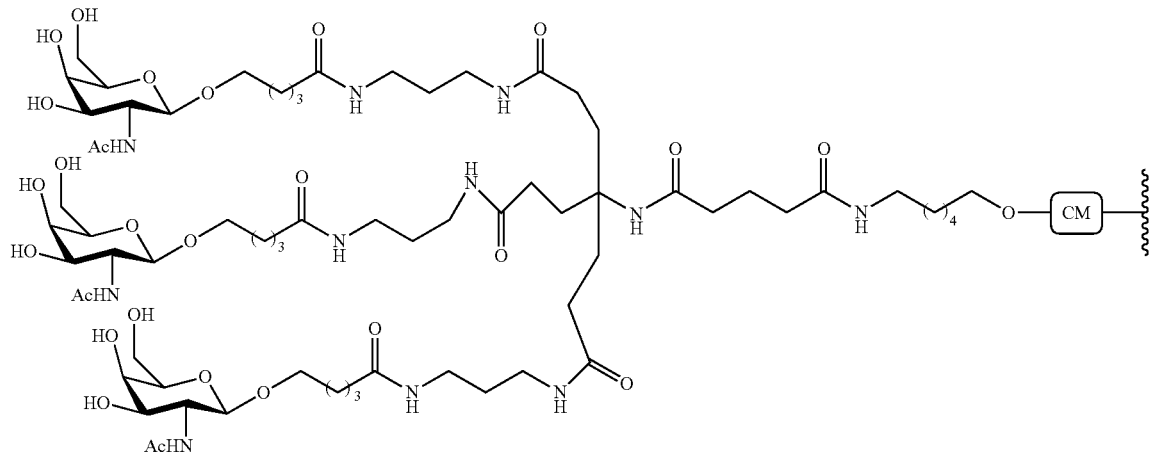

Example 69

Preparation of Oligomeric Compound 201 Comprising GalNAc$_3$-18

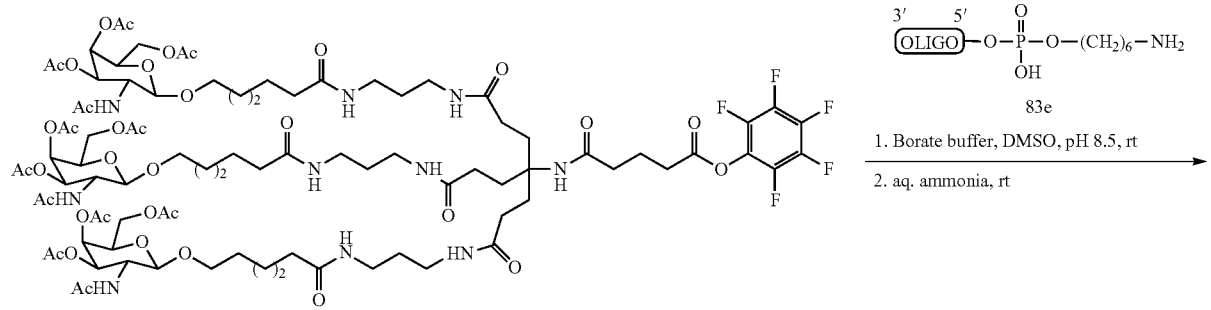

102b

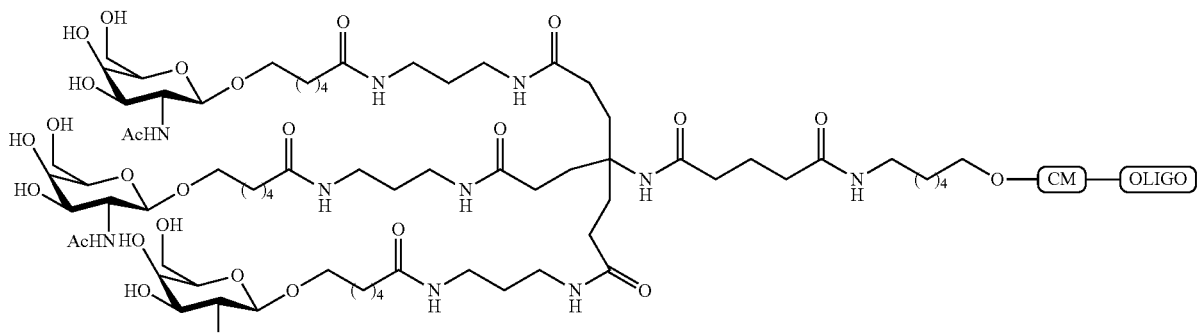

201

Oligomeric compound 201, comprising a GalNAc$_3$-18 conjugate group, was prepared using the general procedures illustrated in Example 46. The GalNAc$_3$ cluster portion of the conjugate group GalNAc$_3$-18 (GalNAc$_3$-18$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-18 (GalNAc$_3$-18$_a$-CM-) is shown below:

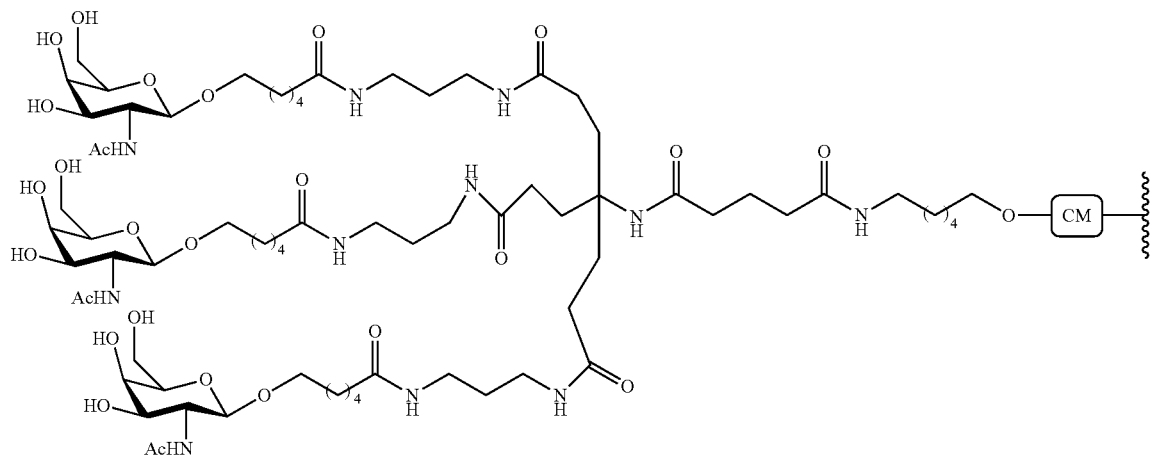

Example 70

Preparation of Oligomeric Compound 204 Comprising GalNAc$_3$-19

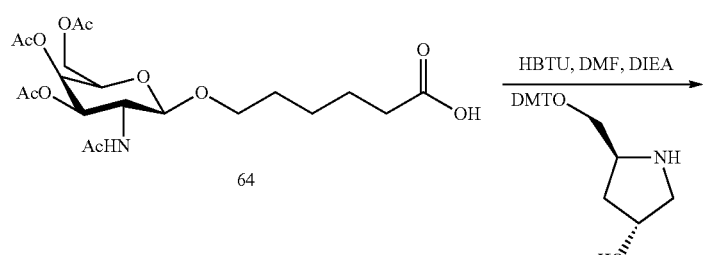

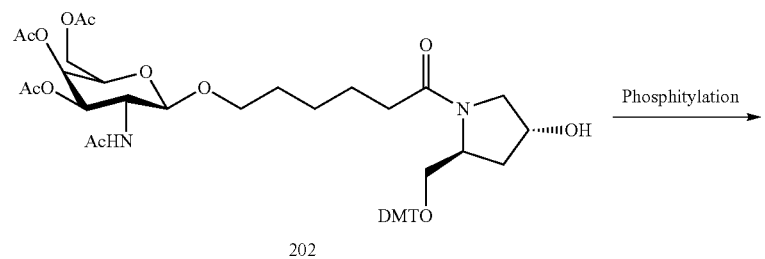

202

Phosphitylation →

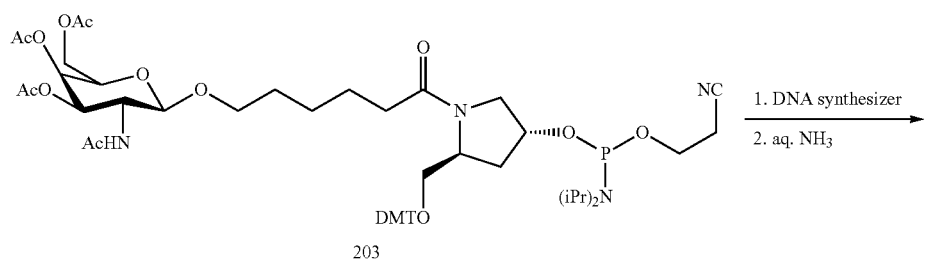

203

1. DNA synthesizer
2. aq. NH₃
→

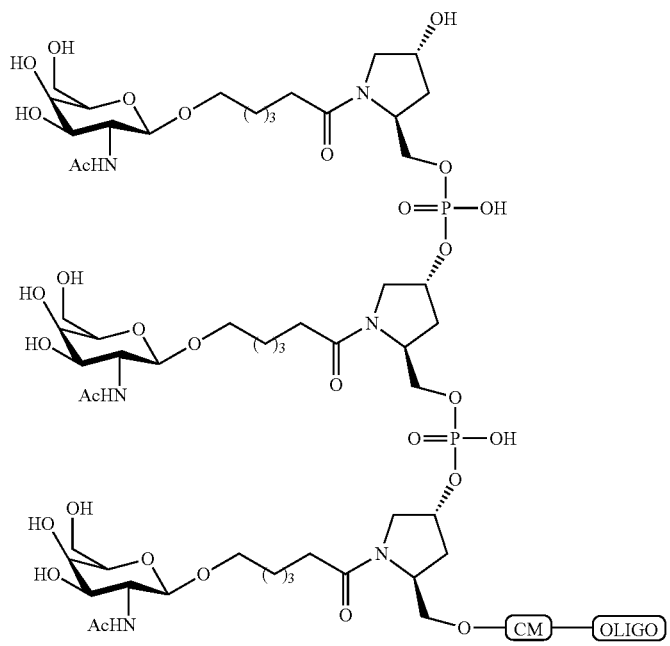

204

Oligomeric compound 204, comprising a GalNAc₃-19 conjugate group, was prepared from compound 64 using the general procedures illustrated in Example 52. The GalNAc₃ cluster portion of the conjugate group GalNAc₃-19 (GalNAc₃-19$_a$) can be combined with any cleavable moiety to provide a variety of conjugate groups. In certain embodiments, the cleavable moiety is —P(=O)(OH)-A$_d$-P(=O)(OH)—. The structure of GalNAc₃-19 (GalNAc₃-19$_a$-CM-) is shown below:

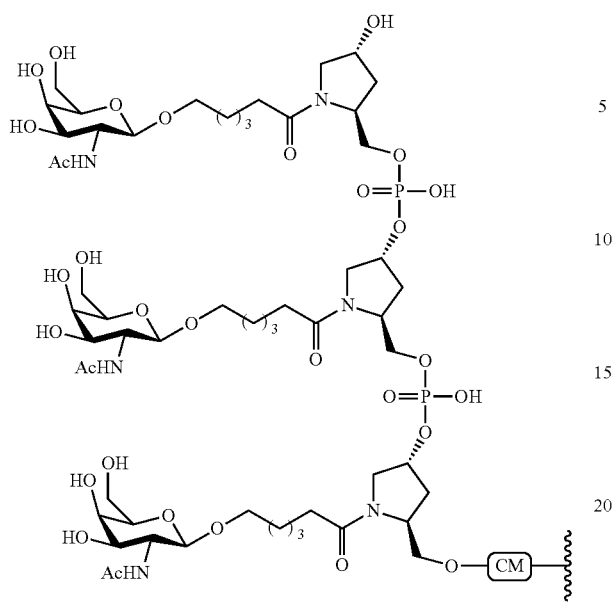
Example 71
Preparation of Oligomeric Compound 210
Comprising GalNAc$_3$-20
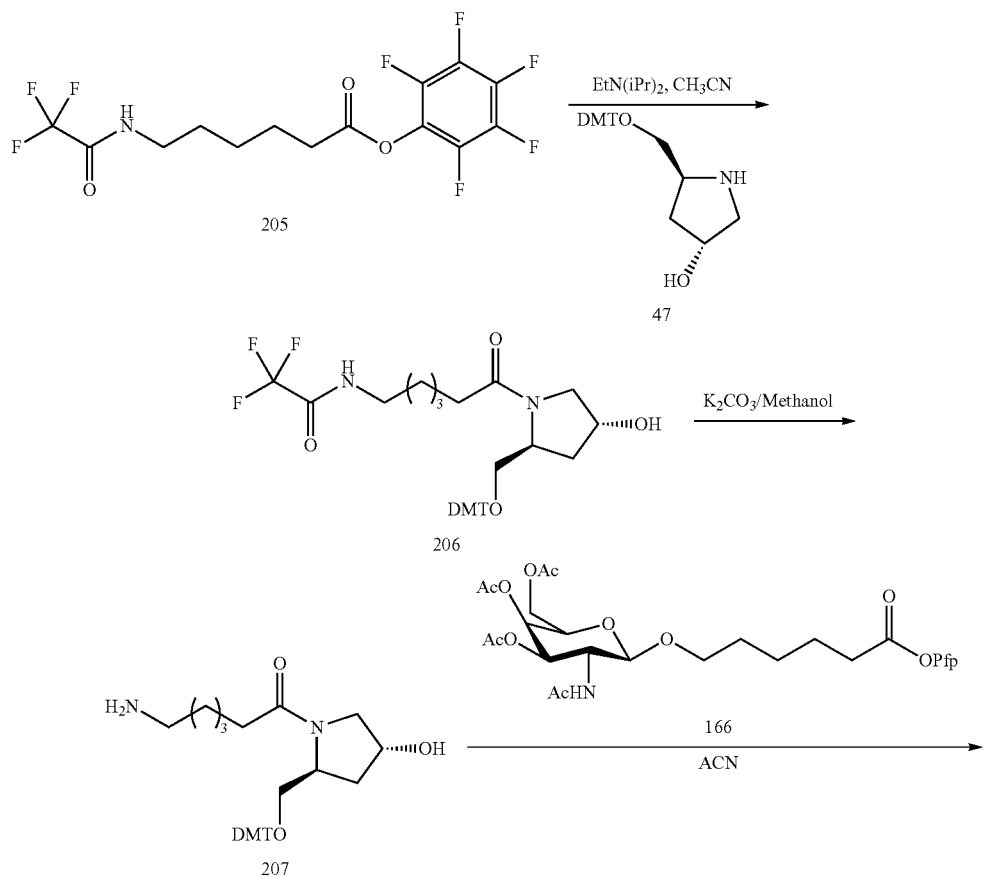

-continued

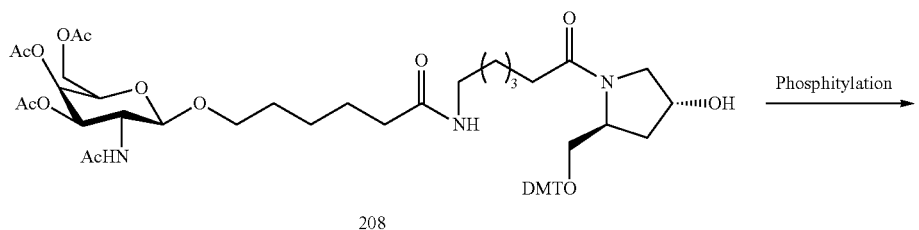
208

Phosphitylation →

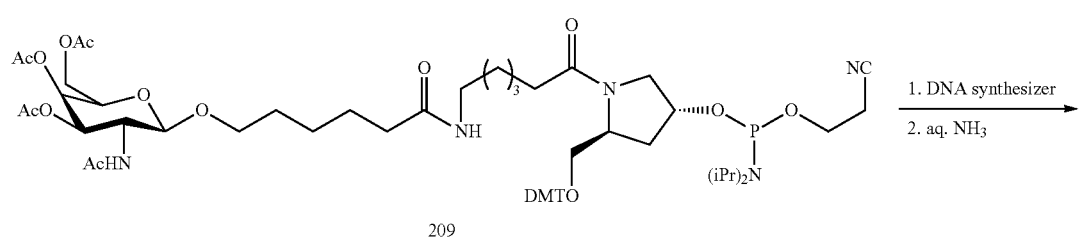
209

1. DNA synthesizer
2. aq. NH₃

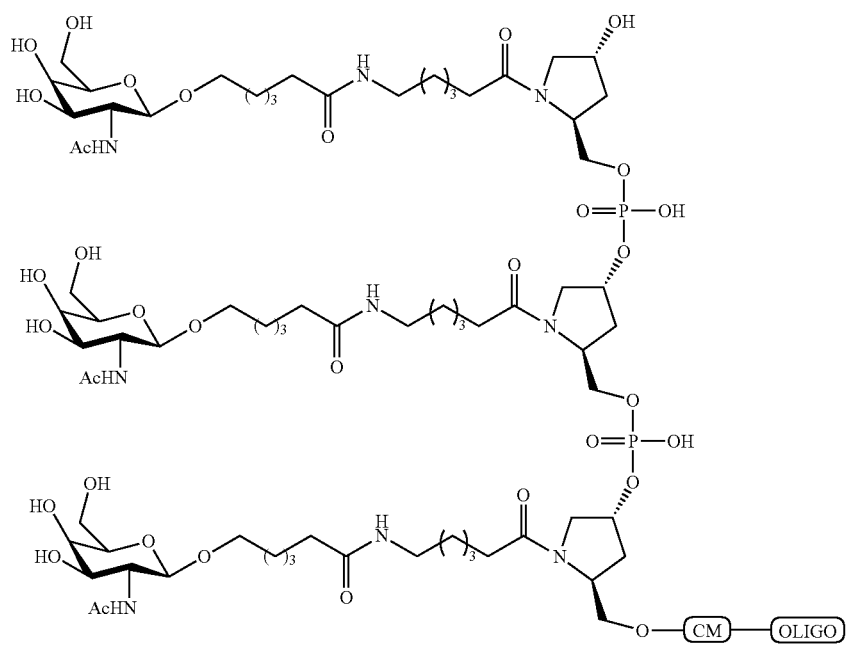
210

Compound 205 was prepared by adding PFP-TFA and DIEA to 6-(2,2,2-trifluoroacetamido)hexanoic acid in acetonitrile, which was prepared by adding triflic anhydride to 6-aminohexanoic acid. The reaction mixture was heated to 80° C., then lowered to rt. Oligomeric compound 210, comprising a GalNAc$_3$-20 conjugate group, was prepared from compound 208 using the general procedures illustrated in Example 52. The GalNAc$_3$ cluster portion of the conjugate group GalNAc$_3$-20 (GalNAc$_3$-20$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-20 (GalNAc$_3$-20$_a$-CM-) is shown below:
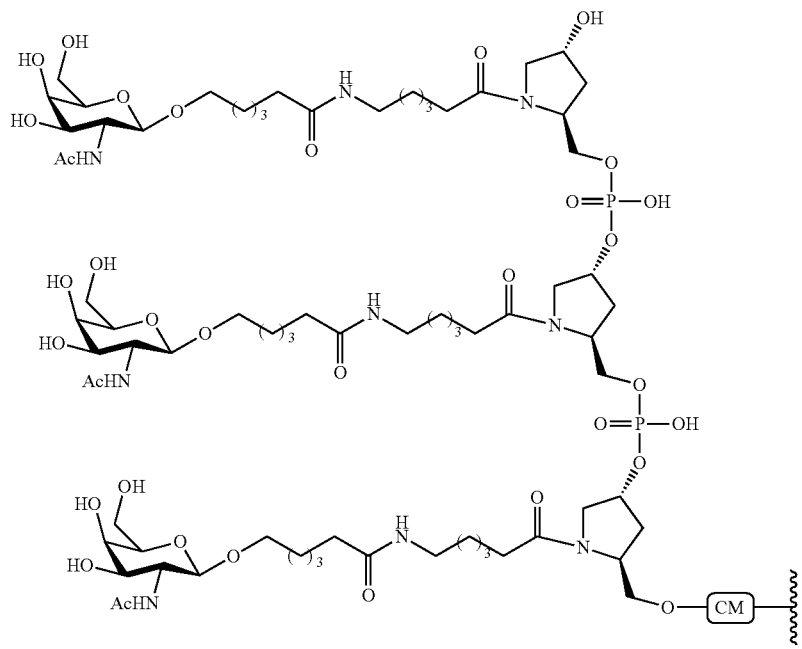
Example 72
Preparation of Oligomeric Compound 215 Comprising GalNAc$_3$-21
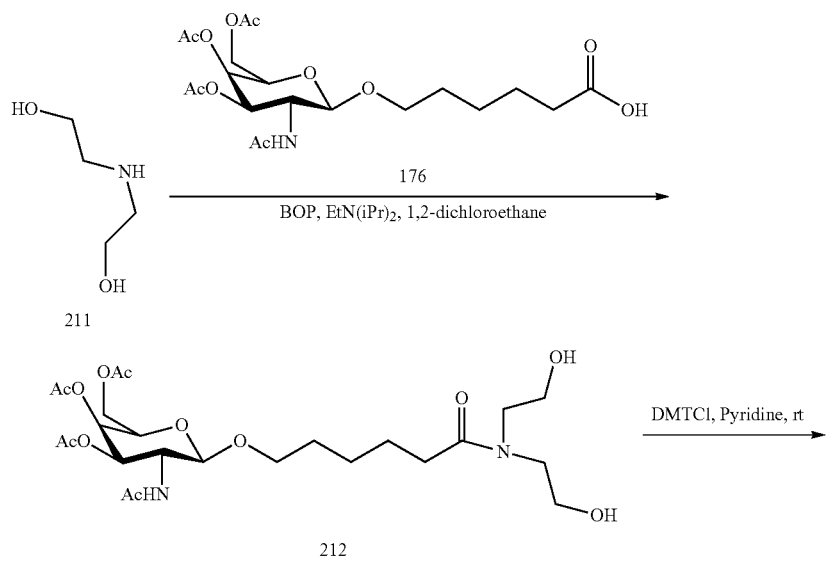

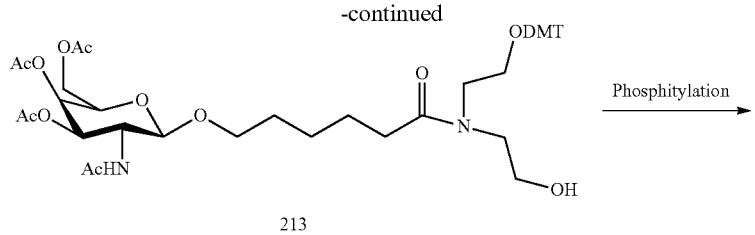

213

Phosphitylation →

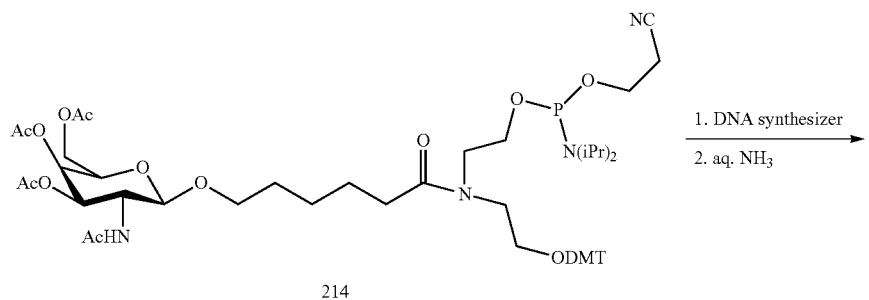

214

1. DNA synthesizer
2. aq. NH₃ →

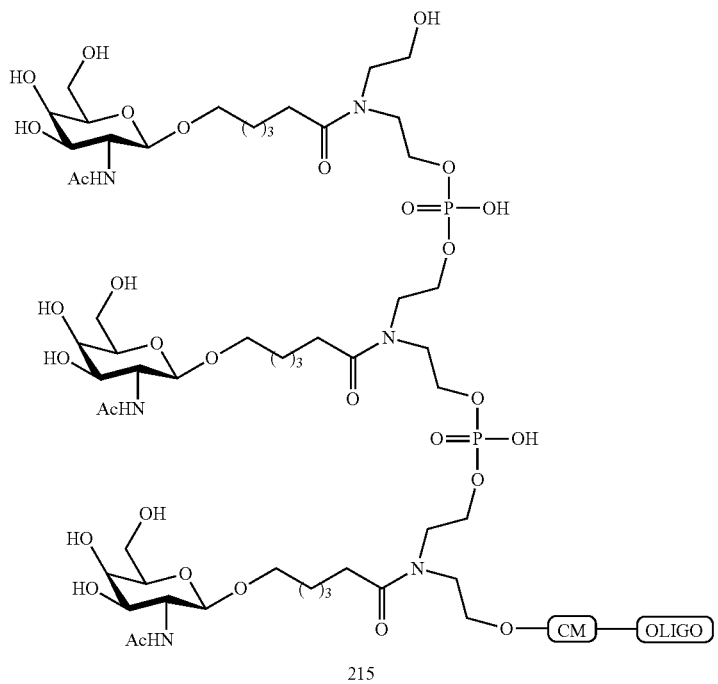

215

Compound 211 is commercially available. Oligomeric compound 215, comprising a GalNAc₃-21 conjugate group, was prepared from compound 213 using the general procedures illustrated in Example 52. The GalNAc₃ cluster portion of the conjugate group GalNAc₃-21 (GalNAc₃-21$_a$) can be combined with any cleavable moiety to provide a variety of conjugate groups. In certain embodiments, the cleavable moiety is —P(=O)(OH)-A$_d$-P(=O)(OH)—. The structure of GalNAc₃-21 (GalNAc₃-21$_a$-CM-) is shown below:

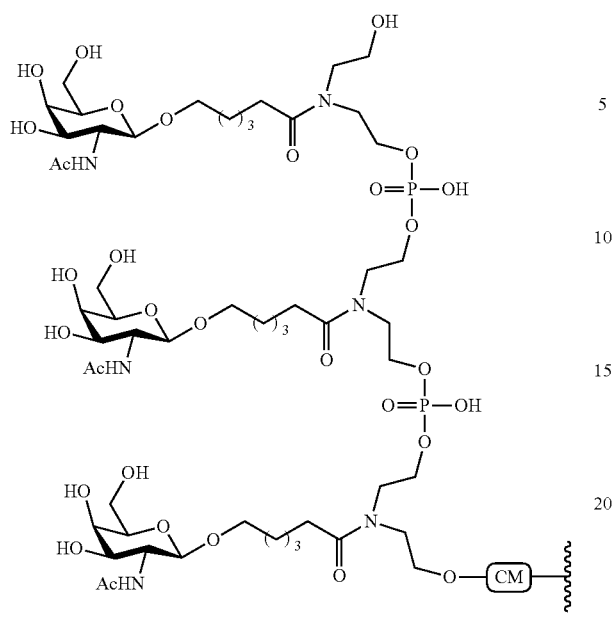
Example 73
Preparation of Oligomeric Compound 221
Comprising GalNAc$_3$-22
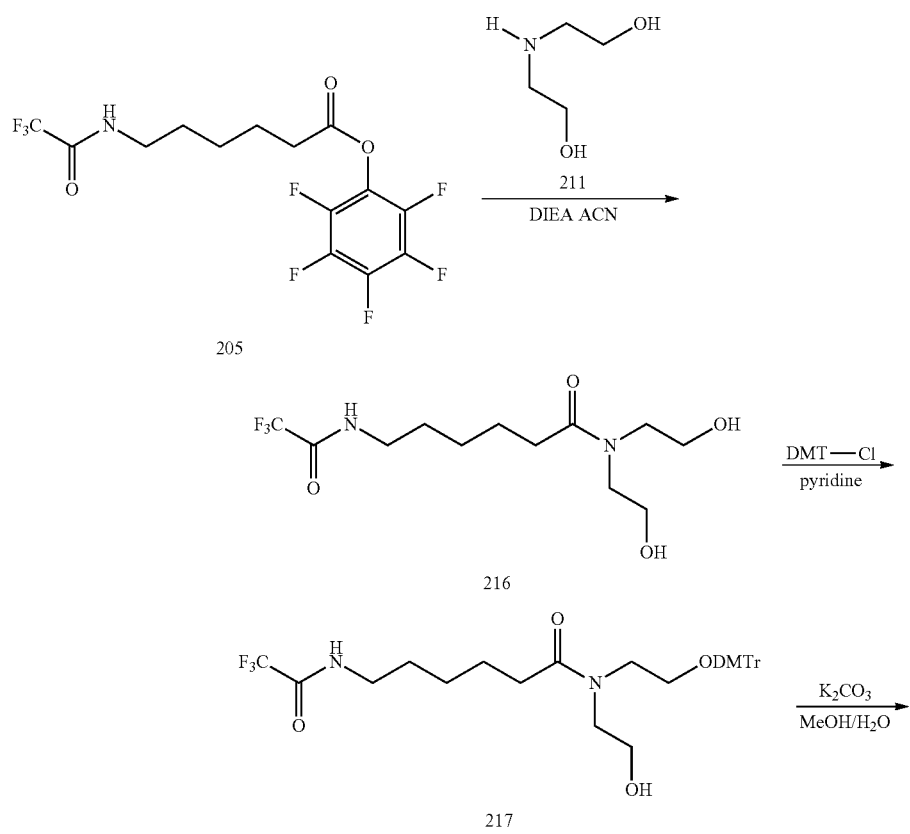

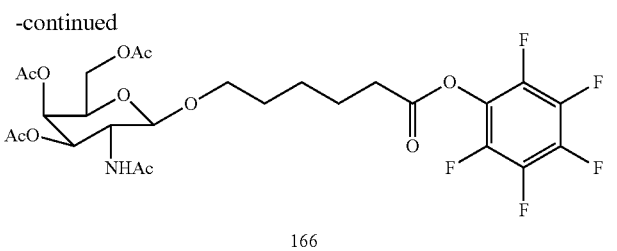

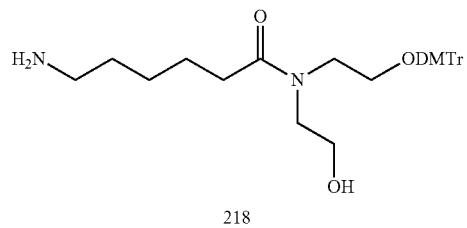

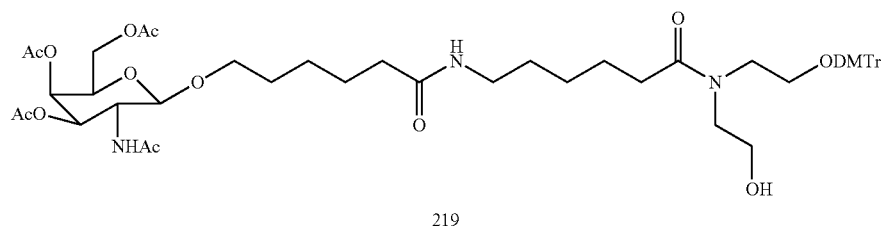

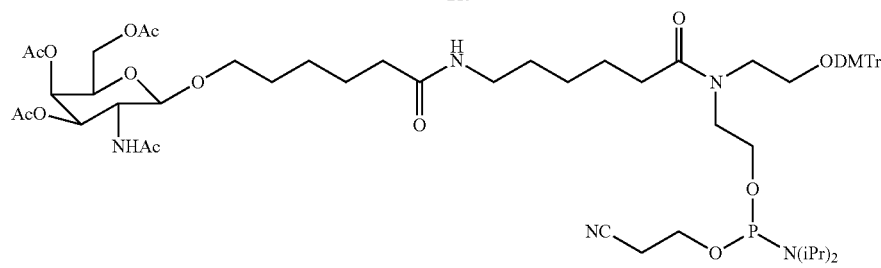

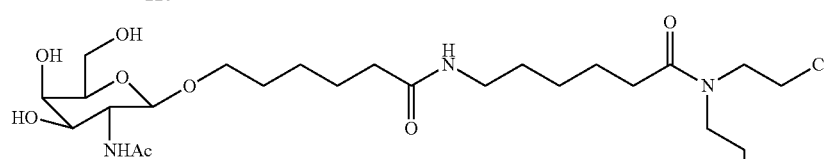

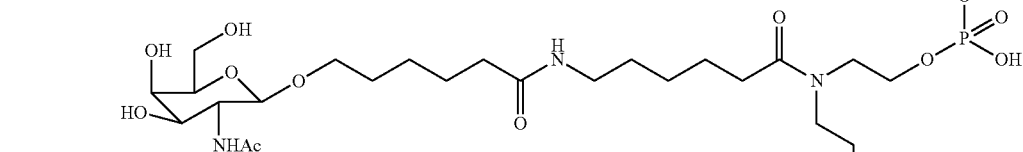

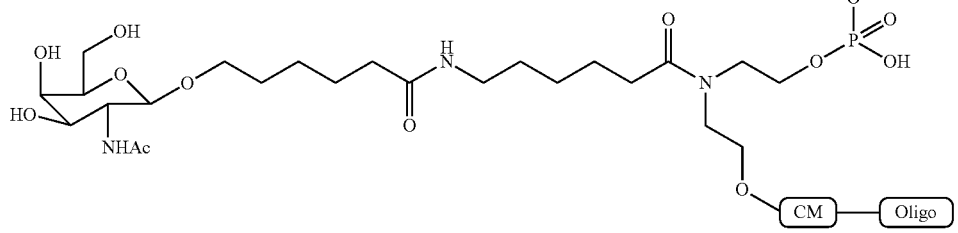

Compound 220 was prepared from compound 219 using diisopropylammonium tetrazolide. Oligomeric compound 221, comprising a GalNAc$_3$-21 conjugate group, is prepared from compound 220 using the general procedure illustrated in Example 52. The GalNAc$_3$ cluster portion of the conjugate group GalNAc$_3$-22 (GalNAc$_3$-22$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-22 (GalNAc$_3$-22$_a$-CM-) is shown below:

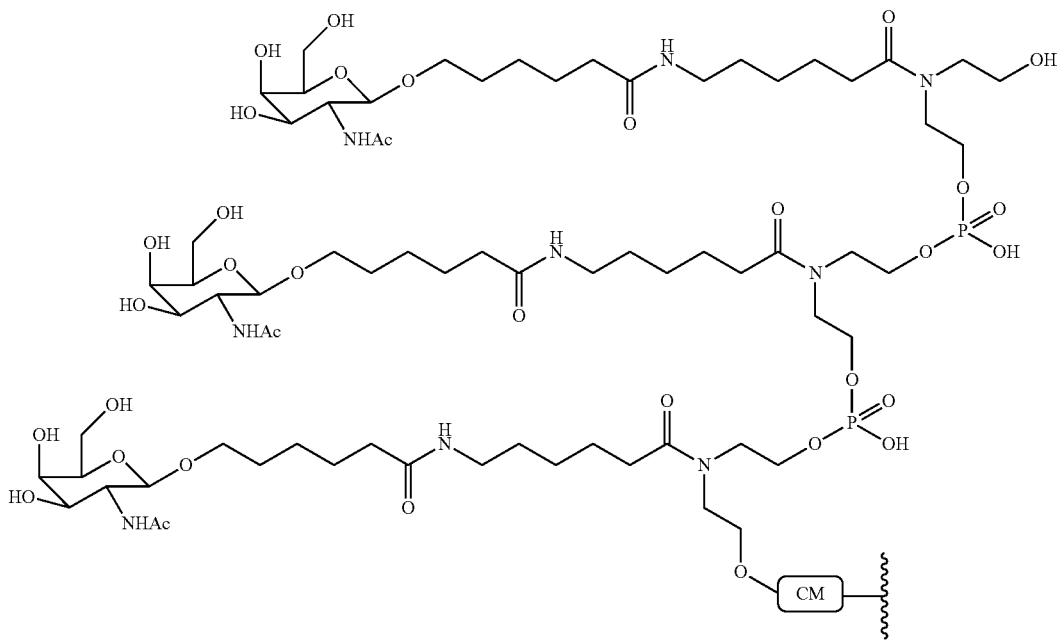

Example 74

Effect of Various Cleavable Moieties on Antisense Inhibition In Vivo by Oligonucleotides Targeting SRB-1 Comprising a 5'-GalNAc₃ Conjugate The oligonucleotides listed below were tested in a dose-dependent study for antisense inhibition of SRB-1 in mice. Each of the GalNAc₃ conjugate groups was attached at the 5' terminus of the respective oligonucleotide.

TABLE 60

Modified ASOs targeting SRB-1

| ISIS No. | Sequence (5' to 3') | GalNAc₃ Cluster | CM | SEQ ID No. |
|---|---|---|---|---|
| 353382 | $G_{es}{}^mC_{es}T_{es}T_{es}{}^mC_{es}A_{ds}G_{ds}T_{ds}{}^m$ $C_{ds}A_{ds}T_{ds}G_{ds}A_{ds}{}^mC_{ds}T_{ds}T_{es}{}^mC_{es}{}^m$ $C_{es}T_{es}T_e$ | n/a | n/a | 2256 |
| 661161 | GalNAc₃-3$_{a-o}$,$A_{do}G_{es}{}^mC_{es}T_{es}$ $T_{es}{}^mC_{es}A_{ds}G_{ds}T_{ds}{}^mC_{ds}A_{ds}T_{ds}G_{ds}$ $A_{ds}{}^mC_{ds}T_{ds}T_{es}{}^mC_{es}{}^mC_{es}T_{es}T_e$ | GalNAc₃-3a | $A_d$ | 2258 |
| 666904 | GalNAc₃-3$_{a-o}$,$G_{es}{}^mC_{es}T_{es}T_{es}{}^m$ $C_{es}A_{ds}G_{ds}T_{ds}{}^mC_{ds}A_{ds}T_{ds}G_{ds}A_{ds}{}^m$ $C_{ds}T_{ds}T_{es}{}^mC_{es}{}^mC_{es}T_{es}T_e$ | GalNAc₃-3a | PO | 2256 |
| 675441 | GalNAc₃-17$_{a-o}$,$A_{do}G_{es}{}^mC_{es}T_{es}$ $T_{es}{}^mC_{es}A_{ds}G_{ds}T_{ds}{}^mC_{ds}A_{ds}T_{ds}G_{ds}$ $A_{ds}{}^mC_{ds}T_{ds}T_{es}{}^mC_{es}{}^mC_{es}T_{es}T_e$ | GalNAc₃-17a | $A_d$ | 2258 |
| 675442 | GalNAc₃-18$_{a-o}$,$A_{do}G_{es}{}^mC_{es}T_{es}$ $T_{es}{}^mC_{es}A_{ds}G_{ds}T_{ds}{}^mC_{ds}A_{ds}T_{ds}G_{ds}$ $A_{ds}{}^mC_{ds}T_{ds}T_{es}{}^mC_{es}{}^mC_{es}T_{es}T_e$ | GalNAc₃-18a | $A_d$ | 2258 |

In all tables, capital letters indicate the nucleobase for each nucleoside and $^mC$ indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc₃-3$_a$ was shown previously in Example 39. The structure of GalNAc₃-17a was shown previously in Example 68, and the structure of GalNAc₃-18a was shown in Example 69.

Treatment

Six to eight week old C57BL/6 mice (Jackson Laboratory, Bar Harbor, Me.) were injected subcutaneously once at the dosage shown below with an oligonucleotide listed in Table 60 or with saline. Each treatment group consisted of 4 animals. The mice were sacrificed 72 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 61, treatment with antisense oligonucleotides lowered SRB-1 mRNA levels in a dose-dependent manner. The antisense oligonucleotides comprising a GalNAc conjugate showed similar potencies and were significantly more potent than the parent oligonucleotide lacking a GalNAc conjugate.

TABLE 61

| | | SRB-1 mRNA (% Saline) | | |
|---|---|---|---|---|
| ISIS No. | Dosage (mg/kg) | SRB-1 mRNA (% Saline) | GalNAc₃ Cluster | CM |
| Saline | n/a | 100.0 | n/a | n/a |
| 353382 | 3 | 79.38 | | |
| | 10 | 68.67 | n/a | n/a |
| | 30 | 40.70 | | |
| 661161 | 0.5 | 79.18 | GalNAc₃-3a | $A_d$ |
| | 1.5 | 75.96 | | |
| | 5 | 30.53 | | |
| | 15 | 12.52 | | |

TABLE 61-continued

SRB-1 mRNA (% Saline)

| ISIS No. | Dosage (mg/kg) | SRB-1 mRNA (% Saline) | GalNAc$_3$ Cluster | CM |
|---|---|---|---|---|
| 666904 | 0.5 | 91.30 | GalNAc$_3$-3a | PO |
|  | 1.5 | 57.88 |  |  |
|  | 5 | 21.22 |  |  |
|  | 15 | 16.49 |  |  |
| 675441 | 0.5 | 76.71 | GalNAc$_3$-17a | A$_d$ |
|  | 1.5 | 63.63 |  |  |
|  | 5 | 29.57 |  |  |
|  | 15 | 13.49 |  |  |
| 675442 | 0.5 | 95.03 | GalNAc$_3$-18a | A$_d$ |
|  | 1.5 | 60.06 |  |  |
|  | 5 | 31.04 |  |  |
|  | 15 | 19.40 |  |  |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group (data not shown). ALTs, ASTs, total bilirubin and BUN values are shown in Table 62 below.

TABLE 62

| ISIS No. | Dosage (mg/kg) | ALT (U/L) | AST (U/L) | Total Bilirubin (mg/dL) | BUN (mg/dL) | GalNAc$_3$ Cluster | CM |
|---|---|---|---|---|---|---|---|
| Saline | n/a | 26 | 59 | 0.16 | 42 | n/a | n/a |
| 353382 | 3 | 23 | 58 | 0.18 | 39 | n/a | n/a |
|  | 10 | 28 | 58 | 0.16 | 43 |  |  |
|  | 30 | 20 | 48 | 0.12 | 34 |  |  |
| 661161 | 0.5 | 30 | 47 | 0.13 | 35 | GalNAc$_3$-3a | A$_d$ |
|  | 1.5 | 23 | 53 | 0.14 | 37 |  |  |
|  | 5 | 26 | 48 | 0.15 | 39 |  |  |
|  | 15 | 32 | 57 | 0.15 | 42 |  |  |
| 666904 | 0.5 | 24 | 73 | 0.13 | 36 | GalNAc$_3$-3a | PO |
|  | 1.5 | 21 | 48 | 0.12 | 32 |  |  |
|  | 5 | 19 | 49 | 0.14 | 33 |  |  |
|  | 15 | 20 | 52 | 0.15 | 26 |  |  |
| 675441 | 0.5 | 42 | 148 | 0.21 | 36 | GalNAc$_3$-17a | A$_d$ |
|  | 1.5 | 60 | 95 | 0.16 | 34 |  |  |
|  | 5 | 27 | 75 | 0.14 | 37 |  |  |
|  | 15 | 24 | 61 | 0.14 | 36 |  |  |
| 675442 | 0.5 | 26 | 65 | 0.15 | 37 | GalNAc$_3$-18a | A$_d$ |
|  | 1.5 | 25 | 64 | 0.15 | 43 |  |  |
|  | 5 | 27 | 69 | 0.15 | 37 |  |  |
|  | 15 | 30 | 84 | 0.14 | 37 |  |  |

Example 75

Pharmacokinetic Analysis of Oligonucleotides Comprising a 5'-Conjugate Group The PK of the ASOs in Tables 54, 57 and 60 above was evaluated using liver samples that were obtained following the treatment procedures described in Examples 65, 66, and 74. The liver samples were minced and extracted using standard protocols and analyzed by IP-HPLC-MS alongside an internal standard. The combined tissue level (μg/g) of all metabolites was measured by integrating the appropriate UV peaks, and the tissue level of the full-length ASO missing the conjugate ("parent," which is Isis No. 353382 in this case) was measured using the appropriate extracted ion chromatograms (EIC).

TABLE 63

PK Analysis in Liver

| ISIS No. | Dosage (mg/kg) | Total Tissue Level by UV (μg/g) | Parent ASO Tissue Level by EIC (μg/g) | GalNAc$_3$ Cluster | CM |
|---|---|---|---|---|---|
| 353382 | 3 | 8.9 | 8.6 | n/a | n/a |
|  | 10 | 22.4 | 21.0 |  |  |
|  | 30 | 54.2 | 44.2 |  |  |
| 661161 | 5 | 32.4 | 20.7 | GalNAc$_3$-3a | A$_d$ |
|  | 15 | 63.2 | 44.1 |  |  |
| 671144 | 5 | 20.5 | 19.2 | GalNAc$_3$-12a | A$_d$ |
|  | 15 | 48.6 | 41.5 |  |  |
| 670061 | 5 | 31.6 | 28.0 | GalNAc$_3$-13a | A$_d$ |
|  | 15 | 67.6 | 55.5 |  |  |
| 671261 | 5 | 19.8 | 16.8 | GalNAc$_3$-14a | A$_d$ |
|  | 15 | 64.7 | 49.1 |  |  |
| 671262 | 5 | 18.5 | 7.4 | GalNAc$_3$-15a | A$_d$ |
|  | 15 | 52.3 | 24.2 |  |  |
| 670699 | 5 | 16.4 | 10.4 | GalNAc$_3$-3a | T$_d$ |
|  | 15 | 31.5 | 22.5 |  |  |
| 670700 | 5 | 19.3 | 10.9 | GalNAc$_3$-3a | A$_e$ |
|  | 15 | 38.1 | 20.0 |  |  |
| 670701 | 5 | 21.8 | 8.8 | GalNAc$_3$-3a | T$_e$ |
|  | 15 | 35.2 | 16.1 |  |  |

TABLE 63-continued

PK Analysis in Liver

| ISIS No. | Dosage (mg/kg) | Total Tissue Level by UV (μg/g) | Parent ASO Tissue Level by EIC (μg/g) | GalNAc$_3$ Cluster | CM |
|---|---|---|---|---|---|
| 671165 | 5 | 27.1 | 26.5 | GalNAc$_3$-13a | A$_d$ |
|  | 15 | 48.3 | 44.3 |  |  |
| 666904 | 5 | 30.8 | 24.0 | GalNAc$_3$-3a | PO |
|  | 15 | 52.6 | 37.6 |  |  |
| 675441 | 5 | 25.4 | 19.0 | GalNAc$_3$-17a | A$_d$ |
|  | 15 | 54.2 | 42.1 |  |  |
| 675442 | 5 | 22.2 | 20.7 | GalNAc$_3$-18a | A$_d$ |
|  | 15 | 39.6 | 29.0 |  |  |

The results in Table 63 above show that there were greater liver tissue levels of the oligonucleotides comprising a GalNAc$_3$ conjugate group than of the parent oligonucleotide that does not comprise a GalNAc$_3$ conjugate group (ISIS 353382) 72 hours following oligonucleotide administration, particularly when taking into consideration the differences in dosing between the oligonucleotides with and without a GalNAc$_3$ conjugate group. Furthermore, by 72 hours, 40-98% of each oligonucleotide comprising a GalNAc$_3$ conjugate group was metabolized to the parent compound, indicating that the GalNAc$_3$ conjugate groups were cleaved from the oligonucleotides.

Example 76

Preparation of Oligomeric Compound 230 Comprising GalNAc$_3$-23

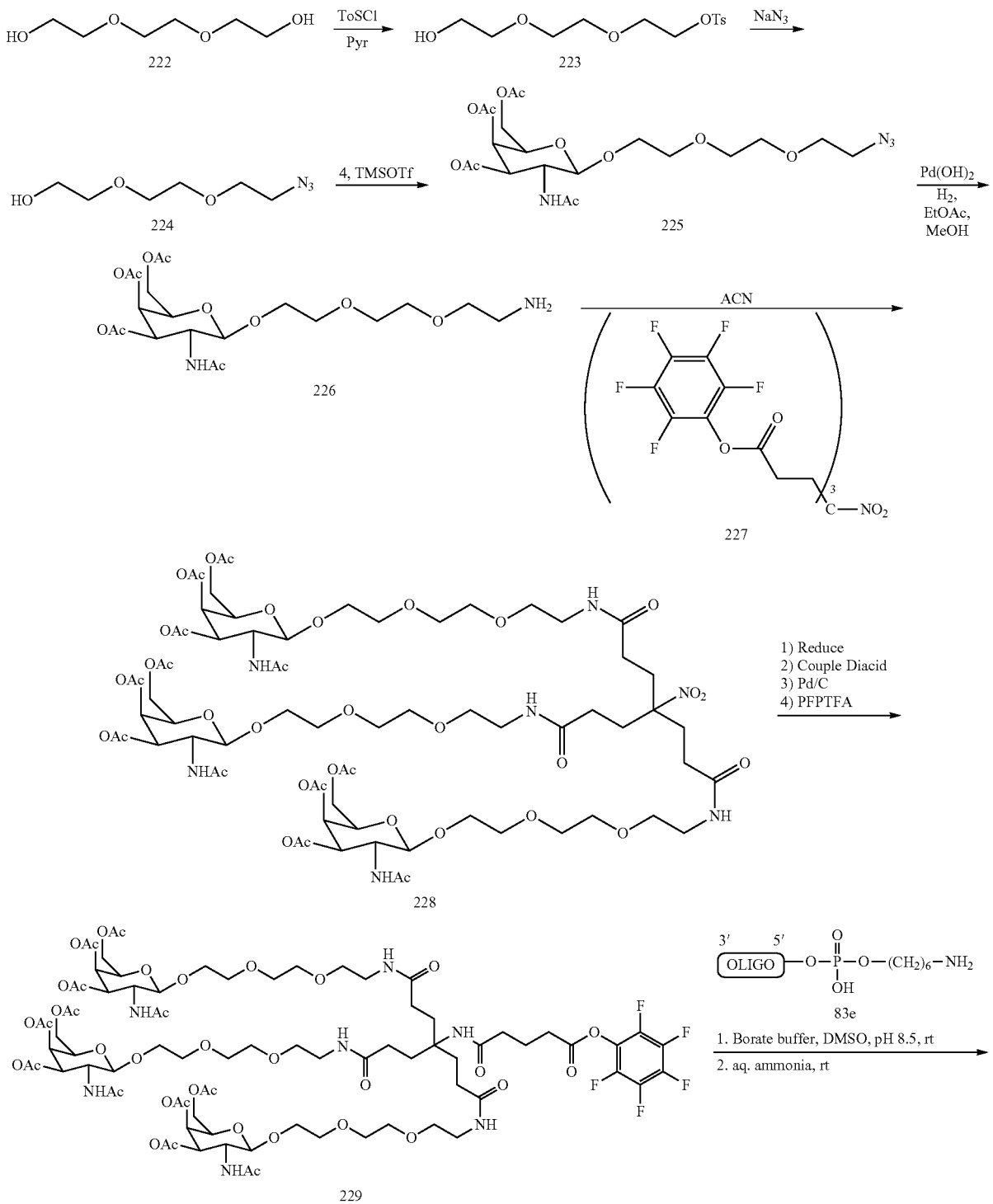

-continued

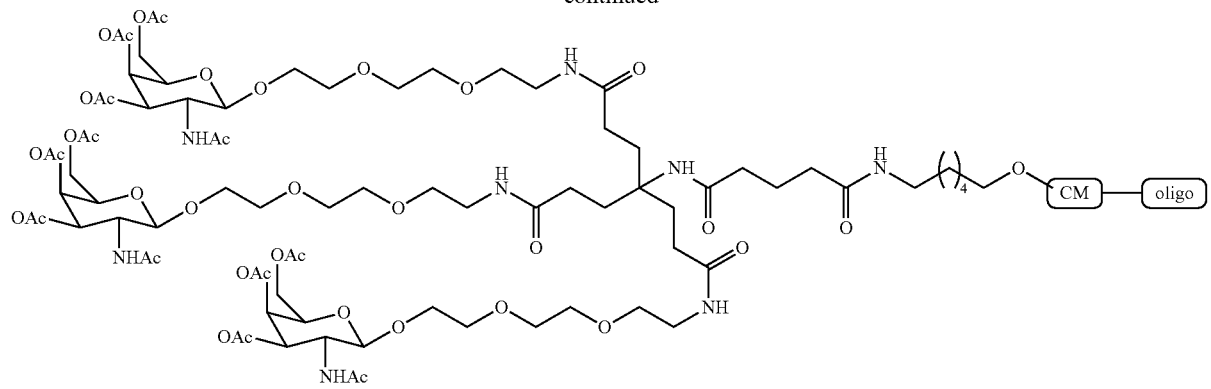

230

Compound 222 is commercially available. 44.48 ml (0.33 mol) of compound 222 was treated with tosyl chloride (25.39 g, 0.13 mol) in pyridine (500 mL) for 16 hours. The reaction was then evaporated to an oil, dissolved in EtOAc and washed with water, sat. NaHCO$_3$, brine, and dried over Na$_2$SO$_4$. The ethyl acetate was concentrated to dryness and purified by column chromatography, eluted with EtOAc/hexanes (1:1) followed by 10% methanol in CH$_2$Cl$_2$ to give compound 223 as a colorless oil. LCMS and NMR were consistent with the structure. 10 g (32.86 mmol) of 1-Tosyltriethylene glycol (compound 223) was treated with sodium azide (10.68 g, 164.28 mmol) in DMSO (100 mL) at room temperature for 17 hours. The reaction mixture was then poured onto water, and extracted with EtOAc. The organic layer was washed with water three times and dried over Na$_2$SO$_4$. The organic layer was concentrated to dryness to give 5.3 g of compound 224 (92%). LCMS and NMR were consistent with the structure. 1-Azidotriethylene glycol (compound 224, 5.53 g, 23.69 mmol) and compound 4 (6 g, 18.22 mmol) were treated with 4A molecular sieves (5 g), and TMSOTf (1.65 ml, 9.11 mmol) in dichloromethane (100 mL) under an inert atmosphere. After 14 hours, the reaction was filtered to remove the sieves, and the organic layer was washed with sat. NaHCO$_3$, water, brine, and dried over Na$_2$SO$_4$. The organic layer was concentrated to dryness and purified by column chromatography, eluted with a gradient of 2 to 4% methanol in dichloromethane to give compound 225. LCMS and NMR were consistent with the structure. Compound 225 (11.9 g, 23.59 mmol) was hydrogenated in EtOAc/Methanol (4:1, 250 mL) over Pearlman's catalyst. After 8 hours, the catalyst was removed by filtration and the solvents removed to dryness to give compound 226. LCMS and NMR were consistent with the structure.

In order to generate compound 227, a solution of nitromethanetrispropionic acid (4.17 g, 15.04 mmol) and Hunig's base (10.3 ml, 60.17 mmol) in DMF (100 mL) were treated dropwise with pentaflourotrifluoro acetate (9.05 ml, 52.65 mmol). After 30 minutes, the reaction was poured onto ice water and extracted with EtOAc. The organic layer was washed with water, brine, and dried over Na$_2$SO$_4$. The organic layer was concentrated to dryness and then recrystallized from heptane to give compound 227 as a white solid. LCMS and NMR were consistent with the structure. Compound 227 (1.5 g, 1.93 mmol) and compound 226 (3.7 g, 7.74 mmol) were stirred at room temperature in acetonitrile (15 mL) for 2 hours. The reaction was then evaporated to dryness and purified by column chromatography, eluting with a gradient of 2 to 10% methanol in dichloromethane to give compound 228. LCMS and NMR were consistent with the structure. Compound 228 (1.7 g, 1.02 mmol) was treated with Raney Nickel (about 2 g wet) in ethanol (100 mL) in an atmosphere of hydrogen. After 12 hours, the catalyst was removed by filtration and the organic layer was evaporated to a solid that was used directly in the next step. LCMS and NMR were consistent with the structure. This solid (0.87 g, 0.53 mmol) was treated with benzylglutaric acid (0.18 g, 0.8 mmol), HBTU (0.3 g, 0.8 mmol) and DIEA (273.7 µl, 1.6 mmol) in DMF (5 mL). After 16 hours, the DMF was removed under reduced pressure at 65° C. to an oil, and the oil was dissolved in dichloromethane. The organic layer was washed with sat. NaHCO$_3$, brine, and dried over Na$_2$SO$_4$. After evaporation of the organic layer, the compound was purified by column chromatography and eluted with a gradient of 2 to 20% methanol in dichloromethane to give the coupled product. LCMS and NMR were consistent with the structure. The benzyl ester was deprotected with Pearlman's catalyst under a hydrogen atmosphere for 1 hour. The catalyst was them removed by filtration and the solvents removed to dryness to give the acid. LCMS and NMR were consistent with the structure. The acid (486 mg, 0.27 mmol) was dissolved in dry DMF (3 mL). Pyridine (53.61 µl, 0.66 mmol) was added and the reaction was purged with argon. Pentaflourotriflouro acetate (46.39 µl, 0.4 mmol) was slowly added to the reaction mixture. The color of the reaction changed from pale yellow to burgundy, and gave off a light smoke which was blown away with a stream of argon. The reaction was allowed to stir at room temperature for one hour (completion of reaction was confirmed by LCMS). The solvent was removed under reduced pressure (rotovap) at 70° C. The residue was diluted with DCM and washed with 1N NaHSO$_4$, brine, saturated sodium bicarbonate and brine again. The organics were dried over Na$_2$SO$_4$, filtered, and were concentrated to dryness to give 225 mg of compound 229 as a brittle yellow foam. LCMS and NMR were consistent with the structure.

Oligomeric compound 230, comprising a GalNAc$_3$-23 conjugate group, was prepared from compound 229 using the general procedure illustrated in Example 46. The GalNAc$_3$ cluster portion of the GalNAc$_3$-23 conjugate group (GalNAc$_3$-23$_a$) can be combined with any cleavable moiety to provide a variety of conjugate groups. The structure of GalNAc$_3$-23 (GalNAc$_3$-23$_a$-CM) is shown below:

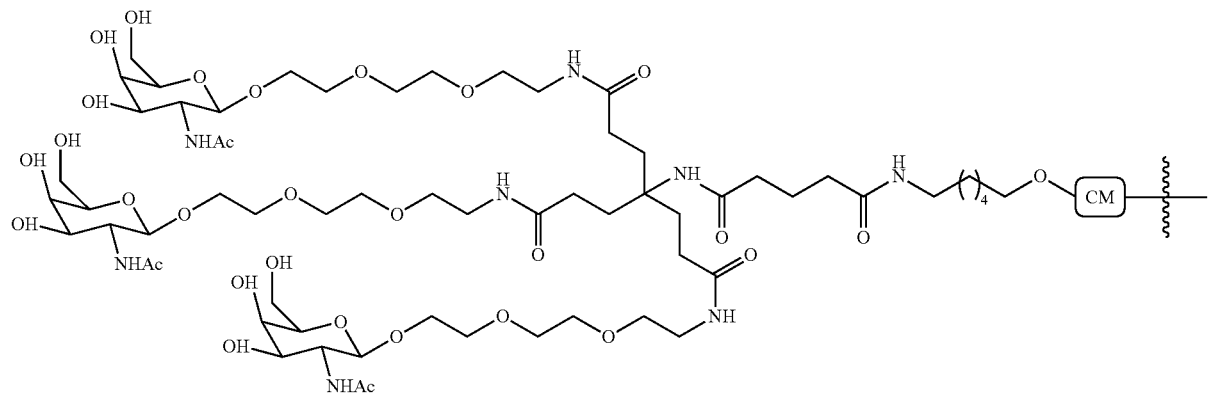

Example 77

Antisense Inhibition In Vivo by Oligonucleotides Targeting SRB-1 Comprising a GalNAc$_3$ Conjugate The oligonucleotides listed below were tested in a dose-dependent study for antisense inhibition of SRB-1 in mice.

TABLE 64

Modified ASOs targeting SRB-1

| ISIS No. | Sequence (5' to 3') | GalNAc$_3$ Cluster | CM | SEQ ID No. |
|---|---|---|---|---|
| 661161 | GalNAc$_3$-3$_{a-o'}$A$_{ds}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3a | A$_d$ | 2258 |
| 666904 | GalNAc$_3$-3$_{a-o'}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3a | PO | 2256 |
| 673502 | GalNAc$_3$-10$_{a-o'}$A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | GalNAc$_3$-10a | A$_d$ | 2258 |
| 677844 | GalNAc$_3$-9$_{a-o'}$A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | GalNAc$_3$-9a | A$_d$ | 2258 |
| 677843 | GalNAc$_3$-23$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-23a | A$_d$ | 2258 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do'}$-GalNAc$_3$-1$_a$ | GalNAc$_3$-1a | A$_d$ | 2257 |
| 677841 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do'}$-GalNAc$_3$-19$_a$ | GalNAc$_3$-19a | A$_d$ | 2257 |
| 677842 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do'}$-GalNAc$_3$-20$_a$ | GalNAc$_3$-20a | A$_d$ | 2257 |

The structure of GalNAc$_3$-1$_a$ was shown previously in Example 9, GalNAc$_3$-3$_a$ was shown in Example 39, GalNAc$_3$-9a was shown in Example 52, GalNAc$_3$-10a was shown in Example 46, GalNAc$_3$-19$_a$ was shown in Example 70, GalNAc$_3$-20$_a$ was shown in Example 71, and GalNAc$_3$-23$_a$ was shown in Example 76.

Treatment

Six to eight week old C57BL/6 mice (Jackson Laboratory, Bar Harbor, Me.) were each injected subcutaneously once at a dosage shown below with an oligonucleotide listed in Table 64 or with saline. Each treatment group consisted of 4 animals. The mice were sacrificed 72 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 65, treatment with antisense oligonucleotides lowered SRB-1 mRNA levels in a dose-dependent manner.

TABLE 65

SRB-1 mRNA (% Saline)

| ISIS No. | Dosage (mg/kg) | SRB-1 mRNA (% Saline) | GalNAc$_3$ Cluster | CM |
|---|---|---|---|---|
| Saline | n/a | 100.0 | n/a | n/a |
| 661161 | 0.5 | 89.18 | GalNAc$_3$-3a | A$_d$ |
|  | 1.5 | 77.02 |  |  |
|  | 5 | 29.10 |  |  |
|  | 15 | 12.64 |  |  |
| 666904 | 0.5 | 93.11 | GalNAc$_3$-3a | PO |
|  | 1.5 | 55.85 |  |  |
|  | 5 | 21.29 |  |  |
|  | 15 | 13.43 |  |  |
| 673502 | 0.5 | 77.75 | GalNAc$_3$-10a | A$_d$ |
|  | 1.5 | 41.05 |  |  |
|  | 5 | 19.27 |  |  |
|  | 15 | 14.41 |  |  |
| 677844 | 0.5 | 87.65 | GalNAc$_3$-9a | A$_d$ |
|  | 1.5 | 93.04 |  |  |
|  | 5 | 40.77 |  |  |
|  | 15 | 16.95 |  |  |
| 677843 | 0.5 | 102.28 | GalNAc$_3$-23a | A$_d$ |
|  | 1.5 | 70.51 |  |  |
|  | 5 | 30.68 |  |  |
|  | 15 | 13.26 |  |  |
| 655861 | 0.5 | 79.72 | GalNAc$_3$-1a | A$_d$ |
|  | 1.5 | 55.48 |  |  |
|  | 5 | 26.99 |  |  |
|  | 15 | 17.58 |  |  |

TABLE 65-continued

SRB-1 mRNA (% Saline)

| ISIS No. | Dosage (mg/kg) | SRB-1 mRNA (% Saline) | GalNAc$_3$ Cluster | CM |
|---|---|---|---|---|
| 677841 | 0.5 | 67.43 | GalNAc$_3$-19a | A$_d$ |
|  | 1.5 | 45.13 |  |  |
|  | 5 | 27.02 |  |  |
|  | 15 | 12.41 |  |  |
| 677842 | 0.5 | 64.13 | GalNAc$_3$-20a | A$_d$ |
|  | 1.5 | 53.56 |  |  |
|  | 5 | 20.47 |  |  |
|  | 15 | 10.23 |  |  |

Liver transaminase levels, alanine aminotransferase (ALT) and aspartate aminotransferase (AST), in serum were also measured using standard protocols. Total bilirubin and BUN were also evaluated. Changes in body weights were evaluated, with no significant change from the saline group (data not shown). ALTs, ASTs, total bilirubin and BUN values are shown in Table 66 below.

TABLE 66

| ISIS No. | Dosage (mg/kg) | ALT (U/L) | AST (U/L) | Total Bilirubin (mg/dL) | BUN (mg/dL) | GalNAc$_3$ Cluster | CM |
|---|---|---|---|---|---|---|---|
| Saline | n/a | 21 | 45 | 0.13 | 34 | n/a | n/a |
| 661161 | 0.5 | 28 | 51 | 0.14 | 39 | GalNAc$_3$-3a | A$_d$ |
|  | 1.5 | 23 | 42 | 0.13 | 39 |  |  |
|  | 5 | 22 | 59 | 0.13 | 37 |  |  |
|  | 15 | 21 | 56 | 0.15 | 35 |  |  |
| 666904 | 0.5 | 24 | 56 | 0.14 | 37 | GalNAc$_3$-3a | PO |
|  | 1.5 | 26 | 68 | 0.15 | 35 |  |  |
|  | 5 | 23 | 77 | 0.14 | 34 |  |  |
|  | 15 | 24 | 60 | 0.13 | 35 |  |  |
| 673502 | 0.5 | 24 | 59 | 0.16 | 34 | GalNAc$_3$-10a | A$_d$ |
|  | 1.5 | 20 | 46 | 0.17 | 32 |  |  |
|  | 5 | 24 | 45 | 0.12 | 31 |  |  |
|  | 15 | 24 | 47 | 0.13 | 34 |  |  |
| 677844 | 0.5 | 25 | 61 | 0.14 | 37 | GalNAc$_3$-9a | A$_d$ |
|  | 1.5 | 23 | 64 | 0.17 | 33 |  |  |
|  | 5 | 25 | 58 | 0.13 | 35 |  |  |
|  | 15 | 22 | 65 | 0.14 | 34 |  |  |
| 677843 | 0.5 | 53 | 53 | 0.13 | 35 | GalNAc$_3$-23a | A$_d$ |
|  | 1.5 | 25 | 54 | 0.13 | 34 |  |  |
|  | 5 | 21 | 60 | 0.15 | 34 |  |  |
|  | 15 | 22 | 43 | 0.12 | 38 |  |  |
| 655861 | 0.5 | 21 | 48 | 0.15 | 33 | GalNAc$_3$-1a | A$_d$ |
|  | 1.5 | 28 | 54 | 0.12 | 35 |  |  |
|  | 5 | 22 | 60 | 0.13 | 36 |  |  |
|  | 15 | 21 | 55 | 0.17 | 30 |  |  |
| 677841 | 0.5 | 32 | 54 | 0.13 | 34 | GalNAc$_3$-19a | A$_d$ |
|  | 1.5 | 24 | 56 | 0.14 | 34 |  |  |
|  | 5 | 23 | 92 | 0.18 | 31 |  |  |
|  | 15 | 24 | 58 | 0.15 | 31 |  |  |
| 677842 | 0.5 | 23 | 61 | 0.15 | 35 | GalNAc$_3$-20a | A$_d$ |
|  | 1.5 | 24 | 57 | 0.14 | 34 |  |  |
|  | 5 | 41 | 62 | 0.15 | 35 |  |  |
|  | 15 | 24 | 37 | 0.14 | 32 |  |  |

Example 78

Antisense Inhibition In Vivo by Oligonucleotides Targeting Angiotensinogen Comprising a GalNAc$_3$ Conjugate The oligonucleotides listed below were tested in a dose-dependent study for antisense inhibition of Angiotensinogen (AGT) in normotensive Sprague Dawley rats.

TABLE 67

Modified ASOs targeting SRB-1

| ISIS No. | Sequence (5' to 3') | GalNAc$_3$ Cluster | CM | SEQ ID No. |
|---|---|---|---|---|
| 552668 | $^mC_{es}A_{es}{}^mC_{es}T_{es}G_{es}A_{ds}T_{ds}T_{ds}T_{ds}$ $T_{ds}T_{ds}G_{ds}{}^mC_{ds}{}^mC_{ds}{}^mC_{ds}A_{es}G_{es}G_{es}$ $A_{es}T_e$ | n/a | n/a | 2262 |
| 669509 | $^mC_{es}A_{es}{}^mC_{es}T_{es}G_{es}A_{ds}T_{ds}T_{ds}T_{ds}$ $T_{ds}T_{ds}G_{ds}{}^mC_{ds}{}^mC_{ds}{}^mC_{ds}A_{es}G_{es}G_{es}$ $A_{es}T_e {}_e A_{do}$, -GalNAc$_3$-1$_a$ | GalNAc$_3$- 1a | A$_d$ | 2263 |

The structure of GalNAc$_3$-1$_a$ was shown previously in Example 9.

Treatment

Six week old, male Sprague Dawley rats were each injected subcutaneously once per week at a dosage shown below, for a total of three doses, with an oligonucleotide listed in Table 67 or with PBS. Each treatment group consisted of 4 animals. The rats were sacrificed 72 hours following the final dose. AGT liver mRNA levels were measured using real-time PCR and RIBOGREEN® RNA quantification reagent (Molecular Probes, Inc. Eugene, Oreg.) according to standard protocols. AGT plasma protein levels were measured using the Total Angiotensinogen ELISA (Catalog #JP27412, IBL International, Toronto, ON) with plasma diluted 1:20,000. The results below are presented as the average percent of AGT mRNA levels in liver or AGT protein levels in plasma for each treatment group, normalized to the PBS control.

As illustrated in Table 68, treatment with antisense oligonucleotides lowered AGT liver mRNA and plasma protein levels in a dose-dependent manner, and the oligonucleotide comprising a GalNAc conjugate was significantly more potent than the parent oligonucleotide lacking a GalNAc conjugate.

TABLE 68

AGT liver mRNA and plasma protein levels

| ISIS No. | Dosage (mg/kg) | AGT liver mRNA (% PBS) | AGT plasma protein (% PBS) | GalNAc$_3$ Cluster | CM |
|---|---|---|---|---|---|
| PBS | n/a | 100 | 100 | n/a | n/a |
| 552668 | 3 | 95 | 122 | n/a | n/a |
|  | 10 | 85 | 97 |  |  |
|  | 30 | 46 | 79 |  |  |
|  | 90 | 8 | 11 |  |  |
| 669509 | 0.3 | 95 | 70 | GalNAc$_3$-1a | A$_d$ |
|  | 1 | 95 | 129 |  |  |
|  | 3 | 62 | 97 |  |  |
|  | 10 | 9 | 23 |  |  |

Liver transaminase levels, alanine aminotransferase (ALT) and aspartate aminotransferase (AST), in plasma and body weights were also measured at time of sacrifice using standard protocols. The results are shown in Table 69 below.

TABLE 69

Liver transaminase levels and rat body weights

| ISIS No. | Dosage (mg/kg) | ALT (U/L) | AST (U/L) | Body Weight (% of baseline) | GalNAc$_3$ Cluster | CM |
|---|---|---|---|---|---|---|
| PBS | n/a | 51 | 81 | 186 | n/a | n/a |
| 552668 | 3 | 54 | 93 | 183 | n/a | n/a |
|  | 10 | 51 | 93 | 194 |  |  |
|  | 30 | 59 | 99 | 182 |  |  |
|  | 90 | 56 | 78 | 170 |  |  |
| 669509 | 0.3 | 53 | 90 | 190 | GalNAc$_3$-1a | A$_d$ |
|  | 1 | 51 | 93 | 192 |  |  |
|  | 3 | 48 | 85 | 189 |  |  |
|  | 10 | 56 | 95 | 189 |  |  |

Example 79

Duration of Action In Vivo of Oligonucleotides Targeting APOC-III Comprising a GalNAc$_3$ Conjugate The oligonucleotides listed in Table 70 below were tested in a single dose study for duration of action in mice.

TABLE 70

Modified ASOs targeting APOC-III

| ISIS No. | Sequence (5' to 3') | GalNAc$_3$ Cluster | CM | SEQ ID No. |
|---|---|---|---|---|
| 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | n/a | n/a | 2248 |
| 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do}$'-GalNAc$_3$-1$_a$ | GalNAc$_3$-1a | A$_d$ | 2249 |

TABLE 70-continued

Modified ASOs targeting APOC-III

| ISIS No. | Sequence (5' to 3') | GalNAc$_3$ Cluster | CM | SEQ ID No. |
|---|---|---|---|---|
| 663083 | GalNAc$_3$-3$_{a-o}$'A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | GalNAc$_3$-3a | A$_d$ | 2264 |
| 674449 | GalNAc$_3$-7$_{a-o}$'A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | GalNAc$_3$-7a | A$_d$ | 2264 |
| 674450 | GalNAc$_3$-10$_{a-o}$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-10a | A$_d$ | 2264 |
| 674451 | GalNAc$_3$-13$_{a-o}$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-13a | A$_d$ | 2264 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, and GalNAc$_3$-13$_a$ was shown in Example 62.

Treatment

Six to eight week old transgenic mice that express human APOC-III were each injected subcutaneously once with an oligonucleotide listed in Table 70 or with PBS. Each treatment group consisted of 3 animals. Blood was drawn before dosing to determine baseline and at 72 hours, 1 week, 2 weeks, 3 weeks, 4 weeks, 5 weeks, and 6 weeks following the dose. Plasma triglyceride and APOC-III protein levels were measured as described in Example 20. The results below are presented as the average percent of plasma triglyceride and APOC-III levels for each treatment group, normalized to baseline levels, showing that the oligonucleotides comprising a GalNAc conjugate group exhibited a longer duration of action than the parent oligonucleotide without a conjugate group (ISIS 304801) even though the dosage of the parent was three times the dosage of the oligonucleotides comprising a GalNAc conjugate group.

TABLE 71

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
| PBS | n/a | 3 | 97 | 102 | n/a | n/a |
|  |  | 7 | 101 | 98 |  |  |
|  |  | 14 | 108 | 98 |  |  |
|  |  | 21 | 107 | 107 |  |  |
|  |  | 28 | 94 | 91 |  |  |
|  |  | 35 | 88 | 90 |  |  |
|  |  | 42 | 91 | 105 |  |  |
| 304801 | 30 | 3 | 40 | 34 | n/a | n/a |
|  |  | 7 | 41 | 37 |  |  |
|  |  | 14 | 50 | 57 |  |  |
|  |  | 21 | 50 | 50 |  |  |
|  |  | 28 | 57 | 73 |  |  |
|  |  | 35 | 68 | 70 |  |  |
|  |  | 42 | 75 | 93 |  |  |

TABLE 71-continued

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc₃ Cluster | CM |
|---|---|---|---|---|---|---|
| 647535 | 10 | 3 | 36 | 37 | GalNAc₃-1a | $A_d$ |
| | | 7 | 39 | 47 | | |
| | | 14 | 40 | 45 | | |
| | | 21 | 41 | 41 | | |
| | | 28 | 42 | 62 | | |
| | | 35 | 69 | 69 | | |
| | | 42 | 85 | 102 | | |
| 663083 | 10 | 3 | 24 | 18 | GalNAc₃-3a | $A_d$ |
| | | 7 | 28 | 23 | | |
| | | 14 | 25 | 27 | | |
| | | 21 | 28 | 28 | | |
| | | 28 | 37 | 44 | | |
| | | 35 | 55 | 57 | | |
| | | 42 | 60 | 78 | | |
| 674449 | 10 | 3 | 29 | 26 | GalNAc₃-7a | $A_d$ |
| | | 7 | 32 | 31 | | |
| | | 14 | 38 | 41 | | |
| | | 21 | 44 | 44 | | |
| | | 28 | 53 | 63 | | |
| | | 35 | 69 | 77 | | |
| | | 42 | 78 | 99 | | |
| 674450 | 10 | 3 | 33 | 30 | GalNAc₃-10a | $A_d$ |
| | | 7 | 35 | 34 | | |
| | | 14 | 31 | 34 | | |
| | | 21 | 44 | 44 | | |
| | | 28 | 56 | 61 | | |
| | | 35 | 68 | 70 | | |
| | | 42 | 83 | 95 | | |
| 674451 | 10 | 3 | 35 | 33 | GalNAc₃-13a | $A_d$ |
| | | 7 | 24 | 32 | | |
| | | 14 | 40 | 34 | | |
| | | 21 | 48 | 48 | | |
| | | 28 | 54 | 67 | | |
| | | 35 | 65 | 75 | | |
| | | 42 | 74 | 97 | | |

Example 80

Antisense Inhibition In Vivo by Oligonucleotides Targeting Alpha-1 Antitrypsin (A1AT) Comprising a GalNAc₃ Conjugate The oligonucleotides listed in Table 72 below were tested in a study for dose-dependent inhibition of A1AT in mice.

TABLE 72

Modified ASOs targeting A1AT

| ISIS No. | Sequence (5' to 3') | GalNAc₃ Cluster | CM | SEQ ID No. |
|---|---|---|---|---|
| 476366 | $A_{es}{}^mC_{es}{}^mC_{es}{}^mC_{es}A_{es}A_{ds}T_{ds}T_{ds}{}^mC_{ds}A_{ds}A_{ds}G_{ds}G_{ds}A_{es}A_{es}G_{es}G_{es}A_e$ | n/a | n/a | 2265 |
| 656326 | $A_{es}{}^mC_{es}{}^mC_{es}{}^mC_{es}A_{es}A_{ds}T_{ds}T_{ds}{}^mC_{ds}A_{ds}A_{ds}G_{ds}G_{ds}A_{es}A_{es}G_{es}G_{es}A_{eo}A_{do}$,-GalNAc₃-1ₐ | GalNAc₃-1a | $A_d$ | 2266 |
| 678381 | GalNAc₃-3$_{a-o}$,$A_{do}$,$A_{es}{}^mC_{es}{}^mC_{es}{}^mC_{es}A_{es}A_{ds}T_{ds}T_{ds}{}^mC_{ds}A_{ds}G_{ds}A_{ds}A_{ds}G_{ds}G_{ds}A_{es}A_{es}G_{es}G_{es}A_e$ | GalNAc₃-3a | $A_d$ | 2267 |
| 678382 | GalNAc₃-7$_{a-o}$,$A_{do}$,$A_{es}{}^mC_{es}{}^mC_{es}{}^mC_{es}A_{es}A_{ds}T_{ds}T_{ds}{}^mC_{ds}A_{ds}G_{ds}A_{ds}A_{ds}G_{ds}G_{ds}A_{es}A_{es}G_{es}G_{es}A_e$ | GalNAc₃-7a | $A_d$ | 2267 |
| 378383 | GalNAc₃-10$_{a-o}$,$A_{do}$,$A_{es}{}^mC_{es}{}^mC_{es}{}^mC_{es}A_{es}A_{ds}T_{ds}T_{ds}{}^mC_{ds}A_{ds}G_{ds}A_{ds}A_{ds}G_{ds}G_{ds}A_{es}A_{es}G_{es}G_{es}A_e$ | GalNAc₃-10a | $A_d$ | 2267 |
| 678384 | GalNAc₃-13$_{a-o}$,$A_{do}$,$A_{es}{}^mC_{es}{}^mC_{es}{}^mC_{es}A_{es}A_{ds}T_{ds}T_{ds}{}^mC_{ds}A_{ds}G_{ds}A_{ds}A_{ds}G_{ds}G_{ds}A_{es}A_{es}G_{es}G_{es}A_e$ | GalNAc₃-13a | $A_d$ | 2267 |

The structure of GalNAc₃-1$_a$ was shown previously in Example 9, GalNAc₃-3$_a$ was shown in Example 39, GalNAc₃-7$_a$ was shown in Example 48, GalNAc₃-10$_a$ was shown in Example 46, and GalNAc₃-13$_a$ was shown in Example 62.

Treatment

Six week old, male C57BL/6 mice (Jackson Laboratory, Bar Harbor, Me.) were each injected subcutaneously once per week at a dosage shown below, for a total of three doses, with an oligonucleotide listed in Table 72 or with PBS. Each treatment group consisted of 4 animals. The mice were sacrificed 72 hours following the final administration. A1AT liver mRNA levels were determined using real-time PCR and RIBOGREEN® RNA quantification reagent (Molecular Probes, Inc. Eugene, Oreg.) according to standard protocols. A1AT plasma protein levels were determined using the Mouse Alpha 1-Antitrypsin ELISA (catalog #41-A1AMS-E01, Alpco, Salem, N.H.). The results below are presented as the average percent of A1AT liver mRNA and plasma protein levels for each treatment group, normalized to the PBS control.

As illustrated in Table 73, treatment with antisense oligonucleotides lowered A1AT liver mRNA and A1AT plasma protein levels in a dose-dependent manner. The oligonucleotides comprising a GalNAc conjugate were significantly more potent than the parent (ISIS 476366).

TABLE 73

A1AT liver mRNA and plasma protein levels

| ISIS No. | Dosage (mg/kg) | A1AT liver mRNA (% PBS) | A1AT plasma protein (% PBS) | GalNAc₃ Cluster | CM |
|---|---|---|---|---|---|
| PBS | n/a | 100 | 100 | n/a | n/a |
| 476366 | 5 | 86 | 78 | n/a | n/a |
| | 15 | 73 | 61 | | |
| | 45 | 30 | 38 | | |
| 656326 | 0.6 | 99 | 90 | GalNAc₃-1a | $A_d$ |
| | 2 | 61 | 70 | | |
| | 6 | 15 | 30 | | |
| | 18 | 6 | 10 | | |
| 678381 | 0.6 | 105 | 90 | GalNAc₃-3a | $A_d$ |
| | 2 | 53 | 60 | | |
| | 6 | 16 | 20 | | |
| | 18 | 7 | 13 | | |
| 678382 | 0.6 | 90 | 79 | GalNAc₃-7a | $A_d$ |
| | 2 | 49 | 57 | | |
| | 6 | 21 | 27 | | |
| | 18 | 8 | 11 | | |
| 678383 | 0.6 | 94 | 84 | GalNAc₃-10a | $A_d$ |
| | 2 | 44 | 53 | | |
| | 6 | 13 | 24 | | |
| | 18 | 6 | 10 | | |

TABLE 73-continued

A1AT liver mRNA and plasma protein levels

| ISIS No. | Dosage (mg/kg) | A1AT liver mRNA (% PBS) | A1AT plasma protein (% PBS) | GalNAc$_3$ Cluster | CM |
|---|---|---|---|---|---|
| 678384 | 0.6 | 106 | 91 | GalNAc$_3$-13a | A$_d$ |
| | 2 | 65 | 59 | | |
| | 6 | 26 | 31 | | |
| | 18 | 11 | 15 | | |

Liver transaminase and BUN levels in plasma were measured at time of sacrifice using standard protocols. Body weights and organ weights were also measured. The results are shown in Table 74 below. Body weight is shown as % relative to baseline. Organ weights are shown as % of body weight relative to the PBS control group.

TABLE 74

| ISIS No. | Dosage (mg/kg) | ALT (U/L) | AST (U/L) | BUN (mg/dL) | Body weight (% baseline) | Liver weight (Rel % BW) | Kidney weight (Rel % BW) | Spleen weight (Rel % BW) |
|---|---|---|---|---|---|---|---|---|
| PBS | n/a | 25 | 51 | 37 | 119 | 100 | 100 | 100 |
| 476366 | 5 | 34 | 68 | 35 | 116 | 91 | 98 | 106 |
| | 15 | 37 | 74 | 30 | 122 | 92 | 101 | 128 |
| | 45 | 30 | 47 | 31 | 118 | 99 | 108 | 123 |
| 656326 | 0.6 | 29 | 57 | 40 | 123 | 100 | 103 | 119 |
| | 2 | 36 | 75 | 39 | 114 | 98 | 111 | 106 |
| | 6 | 32 | 67 | 39 | 125 | 99 | 97 | 122 |
| | 18 | 46 | 77 | 36 | 116 | 102 | 109 | 101 |
| 678381 | 0.6 | 26 | 57 | 32 | 117 | 93 | 109 | 110 |
| | 2 | 26 | 52 | 33 | 121 | 96 | 106 | 125 |
| | 6 | 40 | 78 | 32 | 124 | 92 | 106 | 126 |
| | 18 | 31 | 54 | 28 | 118 | 94 | 103 | 120 |
| 678382 | 0.6 | 26 | 42 | 35 | 114 | 100 | 103 | 103 |
| | 2 | 25 | 50 | 31 | 117 | 91 | 104 | 117 |
| | 6 | 30 | 79 | 29 | 117 | 89 | 102 | 107 |
| | 18 | 65 | 112 | 31 | 120 | 89 | 104 | 113 |
| 678383 | 0.6 | 30 | 67 | 38 | 121 | 91 | 100 | 123 |
| | 2 | 33 | 53 | 33 | 118 | 98 | 102 | 121 |
| | 6 | 32 | 63 | 32 | 117 | 97 | 105 | 105 |
| | 18 | 36 | 68 | 31 | 118 | 99 | 103 | 108 |
| 678384 | 0.6 | 36 | 63 | 31 | 118 | 98 | 103 | 98 |
| | 2 | 32 | 61 | 32 | 119 | 93 | 102 | 114 |
| | 6 | 34 | 69 | 34 | 122 | 100 | 100 | 96 |
| | 18 | 28 | 54 | 30 | 117 | 98 | 101 | 104 |

Example 81

Duration of Action In Vivo of Oligonucleotides Targeting A1AT Comprising a GalNAc$_3$ Cluster The oligonucleotides listed in Table 72 were tested in a single dose study for duration of action in mice.

Treatment

Six week old, male C57BL/6 mice were each injected subcutaneously once with an oligonucleotide listed in Table 72 or with PBS. Each treatment group consisted of 4 animals. Blood was drawn the day before dosing to determine baseline and at 5, 12, 19, and 25 days following the dose. Plasma A1AT protein levels were measured via ELISA (see Example 80). The results below are presented as the average percent of plasma A1AT protein levels for each treatment group, normalized to baseline levels. The results show that the oligonucleotides comprising a GalNAc conjugate were more potent and had longer duration of action than the parent lacking a GalNAc conjugate (ISIS 476366). Furthermore, the oligonucleotides comprising a 5'-GalNAc conjugate (ISIS 678381, 678382, 678383, and 678384) were generally even more potent with even longer duration of action than the oligonucleotide comprising a 3'-GalNAc conjugate (ISIS 656326).

TABLE 75

Plasma A1AT protein levels in mice

| ISIS No. | Dosage (mg/kg) | Time point (days post-dose) | A1AT (% baseline) | GalNAc$_3$ Cluster | CM |
|---|---|---|---|---|---|
| PBS | n/a | 5 | 93 | n/a | n/a |
| | | 12 | 93 | | |
| | | 19 | 90 | | |
| | | 25 | 97 | | |
| 476366 | 100 | 5 | 38 | n/a | n/a |
| | | 12 | 46 | | |
| | | 19 | 62 | | |
| | | 25 | 77 | | |

TABLE 75-continued

Plasma A1AT protein levels in mice

| ISIS No. | Dosage (mg/kg) | Time point (days post-dose) | A1AT (% baseline) | GalNAc$_3$ Cluster | CM |
|---|---|---|---|---|---|
| 656326 | 18 | 5 | 33 | GalNAc$_3$-1a | A$_d$ |
| | | 12 | 36 | | |
| | | 19 | 51 | | |
| | | 25 | 72 | | |
| 678381 | 18 | 5 | 21 | GalNAc$_3$-3a | A$_d$ |
| | | 12 | 21 | | |
| | | 19 | 35 | | |
| | | 25 | 48 | | |
| 678382 | 18 | 5 | 21 | GalNAc$_3$-7a | A$_d$ |
| | | 12 | 21 | | |
| | | 19 | 39 | | |
| | | 25 | 60 | | |
| 678383 | 18 | 5 | 24 | GalNAc$_3$-10a | A$_d$ |
| | | 12 | 21 | | |
| | | 19 | 45 | | |
| | | 25 | 73 | | |

TABLE 75-continued

Plasma A1AT protein levels in mice

| ISIS No. | Dosage (mg/kg) | Time point (days post-dose) | A1AT (% baseline) | GalNAc$_3$ Cluster | CM |
|---|---|---|---|---|---|
| 678384 | 18 | 5 | 29 | GalNAc$_3$-13a | A$_d$ |
|  |  | 12 | 34 |  |  |
|  |  | 19 | 57 |  |  |
|  |  | 25 | 76 |  |  |

Example 82

Antisense Inhibition In Vitro by Oligonucleotides Targeting SRB-1 Comprising a GalNAc$_3$ Conjugate Primary mouse liver hepatocytes were seeded in 96 well plates at 15,000 cells/well 2 hours prior to treatment. The oligonucleotides listed in Table 76 were added at 2, 10, 50, or 250 nM in Williams E medium and cells were incubated overnight at 37° C. in 5% $CO_2$. Cells were lysed 16 hours following oligonucleotide addition, and total RNA was purified using RNease 3000 BioRobot (Qiagen). SRB-1 mRNA levels were determined using real-time PCR and RIBOGREEN® RNA quantification reagent (Molecular Probes, Inc. Eugene, Oreg.) according to standard protocols. IC$_{50}$ values were determined using Prism 4 software (Graph-Pad). The results show that oligonucleotides comprising a variety of different GalNAc conjugate groups and a variety of different cleavable moieties are significantly more potent in an in vitro free uptake experiment than the parent oligonucleotides lacking a GalNAc conjugate group (ISIS 353382 and 666841).

TABLE 76

Inhibition of SRB-1 expression in vitro

| ISIS No. | Sequences | Linkages | GalNAc cluster | CM | IC$_{50}$ (nM) | SEQ ID No. |
|---|---|---|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | n/a | n/a | 250 | 2256 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$,-GalNAc$_3$-1$_a$ | PS | GalNAc$_3$-1$_a$ | A$_d$ | 40 | 2257 |
| 661161 | GalNAc$_3$-3$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-3$_a$ | A$_d$ | 40 | 2258 |
| 661162 | GalNAc$_3$-3$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-3$_a$ | A$_d$ | 8 | 2258 |
| 664078 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$,-GalNAc$_3$-9$_a$ | PS | GalNAc$_3$-9$_a$ | A$_d$ | 20 | 2257 |
| 665001 | GalNAc$_3$-8$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-8$_a$ | A$_d$ | 70 | 2258 |
| 666224 | GalNAc$_3$-5$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-5$_a$ | A$_d$ | 80 | 2258 |
| 666841 | G$_{es}$$^m$C$_{eo}$T$_{eo}$T$_{eo}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{os}$$^m$C$_{eo}$$^m$C$_{es}$T$_{es}$T$_e$ | PO/PS | n/a | n/a | >250 | 2256 |
| 666881 | GalNAc$_3$-10$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-10$_a$ | A$_d$ | 30 | 2258 |
| 666904 | GalNAc$_3$-3$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-3$_a$ | PO | 9 | 2256 |
| 666924 | GalNAc$_3$-3$_{a-o}$,T$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-3$_a$ | T$_d$ | 15 | 2261 |
| 666961 | GalNAc$_3$-6$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-6$_a$ | A$_d$ | 150 | 2258 |
| 666981 | GalNAc$_3$-7$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-7$_a$ | A$_d$ | 20 | 2258 |
| 670061 | GalNAc$_3$-13$_{a-o}$,A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-13$_a$ | A$_d$ | 30 | 2258 |
| 670699 | GalNAc$_3$-3$_{a-o}$,T$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-3$_a$ | T$_d$ | 15 | 2261 |
| 670700 | GalNAc$_3$-3$_{a-o}$,A$_{eo}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | GalNAc$_3$-3$_a$ | A$_e$ | 30 | 2258 |
| 670701 | GalNAc$_3$-3$_{a-o}$,T$_{eo}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | GalNAc$_3$-3$_a$ | T$_e$ | 25 | 2261 |

TABLE 76-continued

Inhibition of SRB-1 expression in vitro

| ISIS No. | Sequences | Linkages | GalNAc cluster | CM | IC$_{50}$ (nM) | SEQ ID No. |
|---|---|---|---|---|---|---|
| 671144 | GalNAc$_3$-12$_{a-o}$,A$_{do}$G$_{es}$$^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-12$_a$ | A$_d$ | 40 | 2258 |
| 671165 | GalNAc$_3$-13$_{a-o}$,A$_{do}$G$_{es}$$^m$C$_{eo}$T$_{eo}$T$_{eo}$$^m$C$_{eo}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | GalNAc$_3$-13$_a$ | A$_d$ | 8 | 2258 |
| 671261 | GalNAc$_3$-14$_{a-o}$,A$_{do}$G$_{es}$$^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-14$_a$ | A$_d$ | >250 | 2258 |
| 671262 | GalNAc$_3$-15$_{a-o}$,A$_{do}$G$_{es}$$^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-15$_a$ | A$_d$ | >250 | 2258 |
| 673501 | GalNAc$_3$-7$_{a-o}$,A$_{do}$G$_{eo}$$^m$C$_{eo}$T$_{eo}$T$_{eo}$$^m$C$_{eo}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | GalNAc$_3$-7$_a$ | A$_d$ | 30 | 2258 |
| 673502 | GalNAc$_3$-10$_{a-o}$,A$_{do}$G$_{eo}$$^m$C$_{eo}$T$_{eo}$T$_{eo}$$^m$C$_{eo}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | GalNAc$_3$-10$_a$ | A$_d$ | 8 | 2258 |
| 675441 | GalNAc$_3$-17$_{a-o}$,A$_{do}$G$_{es}$$^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-17$_a$ | A$_d$ | 30 | 2258 |
| 675442 | GalNAc$_3$-18$_{a-o}$,A$_{do}$G$_{es}$$^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-18$_a$ | A$_d$ | 20 | 2258 |
| 677841 | G$_{es}$$^m$C$_{eo}$T$_{eo}$T$_{eo}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{os}$$^m$C$_{eo}$$^m$C$_{es}$T$_{es}$T$_{eo}$A$_{do}$,-GalNAc$_3$-19$_a$ | PS | GalNAc$_3$-19$_a$ | A$_d$ | 40 | 2257 |
| 677842 | G$_{es}$$^m$C$_{eo}$T$_{eo}$T$_{eo}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{os}$$^m$C$_{eo}$$^m$C$_{es}$T$_{es}$T$_{eo}$A$_{do}$,-GalNAc$_3$-20$_a$ | PS | GalNAc$_3$-20$_a$ | A$_d$ | 30 | 2257 |
| 677843 | GalNAc$_3$-23$_{a-o}$,A$_{do}$G$_{es}$$^m$C$_{es}$T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-23$_a$ | A$_d$ | 40 | 2258 |

The structure of GalNAc$_3$-1$_a$ was shown previously in Example 9, GalNAc$_3$-3$_a$ was shown in Example 39, GalNAc$_3$-5$_a$ was shown in Example 49, GalNAc$_3$-6$_a$ was shown in Example 51, GalNAc$_3$-7$_a$ was shown in Example 48, GalNAc$_3$-8$_a$ was shown in Example 47, GalNAc$_3$-9$_a$ was shown in Example 52, GalNAc$_3$-10$_a$ was shown in Example 46, GalNAc$_3$-12$_a$ was shown in Example 61, GalNAc$_3$-13$_a$ was shown in Example 62, GalNAc$_3$-14$_a$ was shown in Example 63, GalNAc$_3$-15$_a$ was shown in Example 64, GalNAc$_3$-17$_a$ was shown in Example 68, GalNAc$_3$-18$_a$ was shown in Example 69, GalNAc$_3$-19$_a$ was shown in Example 70, GalNAc$_3$-20$_a$ was shown in Example 71, and GalNAc$_3$-23$_a$ was shown in Example 76.

Example 83

Antisense Inhibition In Vivo by Oligonucleotides Targeting Factor XI Comprising a GalNAc$_3$ Cluster The oligonucleotides listed in Table 77 below were tested in a study for dose-dependent inhibition of Factor XI in mice.

TABLE 77

Modified ASOs targeting Factor XI

| ISIS No. | Sequence (5' to 3') | GalNAc$_3$ Cluster | CM | SEQ ID No. |
|---|---|---|---|---|
| 404071 | T$_{es}$G$_{es}$G$_{es}$T$_{es}$A$_{es}$A$_{ds}$T$_{ds}$$^m$C$_{ds}$$^m$C$_{ds}$A$_{ds}$$^m$C$_{ds}$T$_{ds}$T$_{ds}$T$_{ds}$$^m$C$_{ds}$A$_{es}$G$_{es}$A$_{es}$G$_{es}$G$_e$ | n/a | n/a | 2259 |
| 656173 | T$_{es}$G$_{eo}$G$_{eo}$T$_{eo}$A$_{eo}$A$_{ds}$T$_{ds}$$^m$C$_{ds}$$^m$C$_{ds}$ A$_{ds}$$^m$C$_{ds}$T$_{ds}$T$_{ds}$T$_{ds}$$^m$C$_{ds}$A$_{eo}$G$_{eo}$A$_{es}$ G$_{es}$G$_{es}$A$_{do}$-GalNAc$_3$-1$_a$ | GalNAc$_3$-1$_a$ | A$_d$ | 2260 |
| 663086 | GalNAc$_3$-3$_{a-o}$,A$_{do}$T$_{es}$G$_{eo}$G$_{eo}$T$_{eo}$ A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$ T$_{ds}$$^m$C$_{ds}$A$_{eo}$G$_{eo}$A$_{es}$G$_{es}$G$_e$ | GalNAc$_3$-3$_a$ | A$_d$ | 2268 |
| 678347 | GalNAc$_3$-7$_{a-o}$,A$_{do}$T$_{es}$G$_{eo}$G$_{eo}$T$_{eo}$ A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$ T$_{ds}$$^m$C$_{ds}$A$_{eo}$G$_{eo}$A$_{es}$G$_{es}$G$_e$ | GalNAc$_3$-7$_a$ | A$_d$ | 2268 |
| 678348 | GalNAc$_3$-10$_{a-o}$,A$_{do}$T$_{es}$G$_{eo}$G$_{eo}$T$_{eo}$ A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$ T$_{ds}$$^m$C$_{ds}$A$_{eo}$G$_{eo}$A$_{es}$G$_{es}$G$_e$ | GalNAc$_3$-10$_a$ | A$_d$ | 2268 |
| 378349 | GalNAc$_3$-13$_{a-o}$,A$_{do}$T$_{es}$G$_{eo}$G$_{eo}$T$_{eo}$ A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$ T$_{ds}$$^m$C$_{ds}$A$_{eo}$G$_{eo}$A$_{es}$G$_{es}$G$_e$ | GalNAc$_3$-13$_a$ | A$_d$ | 2268 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, and GalNAc$_3$-13$_a$ was shown in Example 62.

Treatment

Six to eight week old mice were each injected subcutaneously once per week at a dosage shown below, for a total of three doses, with an oligonucleotide listed below or with PBS. Each treatment group consisted of 4 animals. The mice were sacrificed 72 hours following the final dose. Factor XI liver mRNA levels were measured using real-time PCR and normalized to cyclophilin according to standard protocols. Liver transaminases, BUN, and bilirubin were also measured. The results below are presented as the average percent for each treatment group, normalized to the PBS control.

As illustrated in Table 78, treatment with antisense oligonucleotides lowered Factor XI liver mRNA in a dose-dependent manner. The results show that the oligonucleotides comprising a GalNAc conjugate were more potent than the parent lacking a GalNAc conjugate (ISIS 404071). Furthermore, the oligonucleotides comprising a 5'-GalNAc conjugate (ISIS 663086, 678347, 678348, and 678349) were even more potent than the oligonucleotide comprising a 3'-GalNAc conjugate (ISIS 656173).

(ISIS 663086, 678347, 678348, and 678349) were even more potent with an even longer duration of action than the oligonucleotide comprising a 3'-GalNAc conjugate (ISIS 656173).

TABLE 79

Plasma Factor XI protein levels in mice

| ISIS No. | Dosage (mg/kg) | Time point (days post-dose) | Factor XI (% baseline) | GalNAc$_3$ Cluster | CM | SEQ ID No. |
|---|---|---|---|---|---|---|
| PBS | n/a | 3 | 123 | n/a | n/a | n/a |
|  |  | 10 | 56 |  |  |  |
|  |  | 17 | 100 |  |  |  |

TABLE 78

Factor XI liver mRNA, liver transaminase, BUN, and bilirubin levels

| ISIS No. | Dosage (mg/kg) | Factor XI mRNA (% PBS) | ALT (U/L) | AST (U/L) | BUN (mg/dL) | Bilirubin (mg/dL) | GalNAc$_3$ Cluster | SEQ ID No. |
|---|---|---|---|---|---|---|---|---|
| PBS | n/a | 100 | 63 | 70 | 21 | 0.18 | n/a | n/a |
| 404071 | 3 | 65 | 41 | 58 | 21 | 0.15 | n/a | 2259 |
|  | 10 | 33 | 49 | 53 | 23 | 0.15 |  |  |
|  | 30 | 17 | 43 | 57 | 22 | 0.14 |  |  |
| 656173 | 0.7 | 43 | 90 | 89 | 21 | 0.16 | GalNAc$_3$-1a | 2260 |
|  | 2 | 9 | 36 | 58 | 26 | 0.17 |  |  |
|  | 6 | 3 | 50 | 63 | 25 | 0.15 |  |  |
| 663086 | 0.7 | 33 | 91 | 169 | 25 | 0.16 | GalNAc$_3$-3a | 2268 |
|  | 2 | 7 | 38 | 55 | 21 | 0.16 |  |  |
|  | 6 | 1 | 34 | 40 | 23 | 0.14 |  |  |
| 678347 | 0.7 | 35 | 28 | 49 | 20 | 0.14 | GalNAc$_3$-7a | 2268 |
|  | 2 | 10 | 180 | 149 | 21 | 0.18 |  |  |
|  | 6 | 1 | 44 | 76 | 19 | 0.15 |  |  |
| 678348 | 0.7 | 39 | 43 | 54 | 21 | 0.16 | GalNAc$_3$-10a | 2268 |
|  | 2 | 5 | 38 | 55 | 22 | 0.17 |  |  |
|  | 6 | 2 | 25 | 38 | 20 | 0.14 |  |  |
| 678349 | 0.7 | 34 | 39 | 46 | 20 | 0.16 | GalNAc$_3$-13a | 2268 |
|  | 2 | 8 | 43 | 63 | 21 | 0.14 |  |  |
|  | 6 | 2 | 28 | 41 | 20 | 0.14 |  |  |

Example 84

Duration of Action In Vivo of Oligonucleotides Targeting Factor XI Comprising a GalNAc$_3$ Conjugate The oligonucleotides listed in Table 77 were tested in a single dose study for duration of action in mice. Treatment Six to eight week old mice were each injected subcutaneously once with an oligonucleotide listed in Table 77 or with PBS. Each treatment group consisted of 4 animals. Blood was drawn by tail bleeds the day before dosing to determine baseline and at 3, 10, and 17 days following the dose. Plasma Factor XI protein levels were measured by ELISA using Factor XI capture and biotinylated detection antibodies from R & D Systems, Minneapolis, Minn. (catalog #AF2460 and #BAF2460, respectively) and the OptEIA Reagent Set B (Catalog #550534, BD Biosciences, San Jose, Calif.). The results below are presented as the average percent of plasma Factor XI protein levels for each treatment group, normalized to baseline levels. The results show that the oligonucleotides comprising a GalNAc conjugate were more potent with longer duration of action than the parent lacking a GalNAc conjugate (ISIS 404071). Furthermore, the oligonucleotides comprising a 5'-GalNAc conjugate TABLE 79-continued Plasma Factor XI protein levels in mice

| ISIS No. | Dosage (mg/kg) | Time point (days post-dose) | Factor XI (% baseline) | GalNAc$_3$ Cluster | CM | SEQ ID No. |
|---|---|---|---|---|---|---|
| 404071 | 30 | 3 | 11 | n/a | n/a | 2259 |
|  |  | 10 | 47 |  |  |  |
|  |  | 17 | 52 |  |  |  |
| 656173 | 6 | 3 | 1 | GalNAc$_3$-1a | A$_d$ | 2260 |
|  |  | 10 | 3 |  |  |  |
|  |  | 17 | 21 |  |  |  |
| 663086 | 6 | 3 | 1 | GalNAc$_3$-3a | A$_d$ | 2268 |
|  |  | 10 | 2 |  |  |  |
|  |  | 17 | 9 |  |  |  |
| 678347 | 6 | 3 | 1 | GalNAc$_3$-7a | A$_d$ | 2268 |
|  |  | 10 | 1 |  |  |  |
|  |  | 17 | 8 |  |  |  |
| 678348 | 6 | 3 | 1 | GalNAc$_3$-10a | A$_d$ | 2268 |
|  |  | 10 | 1 |  |  |  |
|  |  | 17 | 6 |  |  |  |
| 678349 | 6 | 3 | 1 | GalNAc$_3$-13a | A$_d$ | 2268 |
|  |  | 10 | 1 |  |  |  |
|  |  | 17 | 5 |  |  |  |

Example 85

Antisense Inhibition In Vivo by Oligonucleotides Targeting SRB-1 Comprising a GalNAc$_3$ Conjugate Oligonucleotides listed in Table 76 were tested in a dose-dependent study for antisense inhibition of SRB-1 in mice.

Treatment

Six to eight week old C57BL/6 mice were each injected subcutaneously once per week at a dosage shown below, for a total of three doses, with an oligonucleotide listed in Table 76 or with saline. Each treatment group consisted of 4 animals. The mice were sacrificed 48 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of liver SRB-1 mRNA levels for each treatment group, normalized to the saline control.

As illustrated in Tables 80 and 81, treatment with antisense oligonucleotides lowered SRB-1 mRNA levels in a dose-dependent manner.

TABLE 80

SRB-1 mRNA in liver

| ISIS No. | Dosage (mg/kg) | SRB-1 mRNA (% Saline) | GalNAc$_3$ Cluster | CM |
|---|---|---|---|---|
| Saline | n/a | 100 | n/a | n/a |
| 655861 | 0.1 | 94 | GalNAc$_3$-1a | A$_d$ |
|  | 0.3 | 119 |  |  |
|  | 1 | 68 |  |  |
|  | 3 | 32 |  |  |
| 661161 | 0.1 | 120 | GalNAc$_3$-3a | A$_d$ |
|  | 0.3 | 107 |  |  |
|  | 1 | 68 |  |  |
|  | 3 | 26 |  |  |
| 666881 | 0.1 | 107 | GalNAc$_3$-10a | A$_d$ |
|  | 0.3 | 107 |  |  |
|  | 1 | 69 |  |  |
|  | 3 | 27 |  |  |
| 666981 | 0.1 | 120 | GalNAc$_3$-7a | A$_d$ |
|  | 0.3 | 103 |  |  |
|  | 1 | 54 |  |  |
|  | 3 | 21 |  |  |
| 670061 | 0.1 | 118 | GalNAc$_3$-13a | A$_d$ |
|  | 0.3 | 89 |  |  |
|  | 1 | 52 |  |  |
|  | 3 | 18 |  |  |
| 677842 | 0.1 | 119 | GalNAc$_3$-20a | A$_d$ |
|  | 0.3 | 96 |  |  |
|  | 1 | 65 |  |  |
|  | 3 | 23 |  |  |

TABLE 81

SRB-1 mRNA in liver

| ISIS No. | Dosage (mg/kg) | SRB-1 mRNA (% Saline) | GalNAc$_3$ Cluster | CM |
|---|---|---|---|---|
| 661161 | 0.1 | 107 | GalNAc$_3$-3a | A$_d$ |
|  | 0.3 | 95 |  |  |
|  | 1 | 53 |  |  |
|  | 3 | 18 |  |  |
| 677841 | 0.1 | 110 | GalNAc$_3$-19a | A$_d$ |
|  | 0.3 | 88 |  |  |
|  | 1 | 52 |  |  |
|  | 3 | 25 |  |  |

Liver transaminase levels, total bilirubin, BUN, and body weights were also measured using standard protocols. Average values for each treatment group are shown in Table 82 below.

TABLE 82

| ISIS No. | Dosage (mg/kg) | ALT (U/L) | AST (U/L) | Bilirubin (mg/dL) | BUN (mg/dL) | Body Weight (% baseline) | GalNAc$_3$ Cluster | CM |
|---|---|---|---|---|---|---|---|---|
| Saline | n/a | 19 | 39 | 0.17 | 26 | 118 | n/a | n/a |
| 655861 | 0.1 | 25 | 47 | 0.17 | 27 | 114 | GalNAc$_3$-1a | A$_d$ |
|  | 0.3 | 29 | 56 | 0.15 | 27 | 118 |  |  |
|  | 1 | 20 | 32 | 0.14 | 24 | 112 |  |  |
|  | 3 | 27 | 54 | 0.14 | 24 | 115 |  |  |
| 661161 | 0.1 | 35 | 83 | 0.13 | 24 | 113 | GalNAc$_3$-3a | A$_d$ |
|  | 0.3 | 42 | 61 | 0.15 | 23 | 117 |  |  |
|  | 1 | 34 | 60 | 0.18 | 22 | 116 |  |  |
|  | 3 | 29 | 52 | 0.13 | 25 | 117 |  |  |
| 666881 | 0.1 | 30 | 51 | 0.15 | 23 | 118 | GalNAc$_3$-10a | A$_d$ |
|  | 0.3 | 49 | 82 | 0.16 | 25 | 119 |  |  |
|  | 1 | 23 | 45 | 0.14 | 24 | 117 |  |  |
|  | 3 | 20 | 38 | 0.15 | 21 | 112 |  |  |
| 666981 | 0.1 | 21 | 41 | 0.14 | 22 | 113 | GalNAc$_3$-7a | A$_d$ |
|  | 0.3 | 29 | 49 | 0.16 | 24 | 112 |  |  |
|  | 1 | 19 | 34 | 0.15 | 22 | 111 |  |  |

TABLE 82-continued

| ISIS No. | Dosage (mg/kg) | ALT (U/L) | AST (U/L) | Bilirubin (mg/dL) | BUN (mg/dL) | Body Weight (% baseline) | GalNAc$_3$ Cluster | CM |
|---|---|---|---|---|---|---|---|---|
|  | 3 | 77 | 78 | 0.18 | 25 | 115 |  |  |
| 670061 | 0.1 | 20 | 63 | 0.18 | 24 | 111 | GalNAc$_3$-13a | A$_d$ |
|  | 0.3 | 20 | 57 | 0.15 | 21 | 115 |  |  |
|  | 1 | 20 | 35 | 0.14 | 20 | 115 |  |  |
|  | 3 | 27 | 42 | 0.12 | 20 | 116 |  |  |
| 677842 | 0.1 | 20 | 38 | 0.17 | 24 | 114 | GalNAc$_3$-20a | A$_d$ |
|  | 0.3 | 31 | 46 | 0.17 | 21 | 117 |  |  |
|  | 1 | 22 | 34 | 0.15 | 21 | 119 |  |  |
|  | 3 | 41 | 57 | 0.14 | 23 | 118 |  |  |

Example 86

Antisense Inhibition In Vivo by Oligonucleotides Targeting TTR Comprising a GalNAc$_3$ Cluster Oligonucleotides listed in Table 83 below were tested in a dose-dependent study for antisense inhibition of human transthyretin (TTR) in transgenic mice that express the human TTR gene.

Treatment

Eight week old TTR transgenic mice were each injected subcutaneously once per week for three weeks, for a total of three doses, with an oligonucleotide and dosage listed in the tables below or with PBS. Each treatment group consisted of 4 animals. The mice were sacrificed 72 hours following the final administration. Tail bleeds were performed at various time points throughout the experiment, and plasma TTR protein, ALT, and AST levels were measured and reported in Tables 85-87. After the animals were sacrificed, plasma ALT, AST, and human TTR levels were measured, as were body weights, organ weights, and liver human TTR mRNA levels. TTR protein levels were measured using a clinical analyzer (AU480, Beckman Coulter, CA). Real-time PCR and RIBOGREEN® RNA quantification reagent (Molecular Probes, Inc. Eugene, Oreg.) were used according to standard protocols to determine liver human TTR mRNA levels. The results presented in Tables 84-87 are the average values for each treatment group. The mRNA levels are the average values relative to the average for the PBS group. Plasma protein levels are the average values relative to the average value for the PBS group at baseline. Body weights are the average percent weight change from baseline until sacrifice for each individual treatment group. Organ weights shown are normalized to the animal's body weight, and the average normalized organ weight for each treatment group is then presented relative to the average normalized organ weight for the PBS group.

In Tables 84-87, "BL" indicates baseline, measurements that were taken just prior to the first dose. As illustrated in Tables 84 and 85, treatment with antisense oligonucleotides lowered TTR expression levels in a dose-dependent manner. The oligonucleotides comprising a GalNAc conjugate were more potent than the parent lacking a GalNAc conjugate (ISIS 420915). Furthermore, the oligonucleotides comprising a GalNAc conjugate and mixed PS/PO internucleoside linkages were even more potent than the oligonucleotide comprising a GalNAc conjugate and full PS linkages.

TABLE 83

Oligonucleotides targeting human TTR

| ISIS No. | Sequences | Linkages | GalNAc cluster | CM | SEQ ID No. |
|---|---|---|---|---|---|
| 420915 | T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$ G$_{ds}$A$_{ds}$A$_{ds}$A$_{es}$T$_{es}$$^m$C$_{es}$$^m$C$_{es}$$^m$C$_e$ | PS | n/a | n/a | 2269 |
| 660261 | T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$ G$_{ds}$A$_{ds}$A$_{ds}$A$_{es}$T$_{es}$$^m$C$_{es}$$^m$C$_{es}$$^m$C$_{eo}$A$_{do}$-GalNAc$_3$-1$_a$ | PS | GalNAc$_3$-1a | A$_d$ | 2270 |
| 682883 | GalNAc$_3$-3$_{a-o}$'T$_{es}$$^m$C$_{eo}$T$_{eo}$T$_{eo}$G$_{eo}$G$_{ds}$T$_{ds}$ T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_e$ | PO/PS | GalNAc$_3$-3a | PO | 2269 |
| 682884 | GalNAc$_3$-7$_{a-o}$'T$_{es}$$^m$C$_{eo}$T$_{eo}$T$_{eo}$G$_{eo}$G$_{ds}$T$_{ds}$ T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_e$ | PO/PS | GalNAc$_3$-7a | PO | 2269 |
| 682885 | GalNAc$_3$-10$_{a-o}$'T$_{es}$$^m$C$_{eo}$T$_{eo}$T$_{eo}$G$_{eo}$G$_{ds}$T$_{ds}$ T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_e$ | PO/PS | GalNAc$_3$-10a | PO | 2269 |
| 682886 | GalNAc$_3$-13$_{a-o}$'T$_{es}$$^m$C$_{eo}$T$_{eo}$T$_{eo}$G$_{eo}$G$_{ds}$T$_{ds}$ T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_e$ | PO/PS | GalNAc$_3$-13a | PO | 2269 |

TABLE 83-continued

Oligonucleotides targeting human TTR

| ISIS No. | Sequences | Linkages | GalNAc cluster | CM | SEQ ID No. |
|---|---|---|---|---|---|
| 684057 | $T_{es}{}^mC_{eo}T_{eo}T_{eo}G_{eo}G_{ds}T_{ds}T_{ds}A_{ds}{}^mC_{ds}A_{ds}T_{ds}$ $G_{ds}A_{ds}A_{ds}A_{eo}T_{eo}{}^mC_{es}{}^mC_{es}{}^mC_{eo}A_{do}$-GalNAc$_3$-19$_a$ | PO/PS | GalNAc$_3$-19a | $A_d$ | 2270 |

The legend for Table 85 can be found in Example 74. The structure of GalNAc$_3$-1 was shown in Example 9. The structure of GalNAc$_3$-3$_a$ was shown in Example 39. The structure of GalNAc$_3$-7$_a$ was shown in Example 48. The structure of GalNAc$_3$-10$_a$ was shown in Example 46. The structure of GalNAc$_3$-13$_a$ was shown in Example 62. The structure of GalNAc$_3$-19$_a$ was shown in Example 70.

TABLE 84

Antisense inhibition of human TTR in vivo

| Isis No. | Dosage (mg/kg) | TTR mRNA (% PBS) | Plasma TTR protein (% PBS) | GalNAc cluster | CM | SEQ ID No. |
|---|---|---|---|---|---|---|
| PBS | n/a | 100 | 100 | n/a | n/a | |
| 420915 | 6 | 99 | 95 | n/a | n/a | 2269 |
| | 20 | 48 | 65 | | | |
| | 60 | 18 | 28 | | | |
| 660261 | 0.6 | 113 | 87 | GalNAc$_3$-1a | $A_d$ | 2270 |
| | 2 | 40 | 56 | | | |
| | 6 | 20 | 27 | | | |
| | 20 | 9 | 11 | | | |

TABLE 85

Antisense inhibition of human TTR in vivo

| Isis No. | Dosage (mg/kg) | TTR mRNA (% PBS) | Plasma TTR protein (% PBS at BL) | | | | GalNAc cluster | CM | SEQ ID No. |
|---|---|---|---|---|---|---|---|---|---|
| | | | BL | Day 3 | Day 10 | Day 17 (After sac) | | | |
| PBS | n/a | 100 | 100 | 96 | 90 | 114 | n/a | n/a | |
| 420915 | 6 | 74 | 106 | 86 | 76 | 83 | n/a | n/a | 2269 |
| | 20 | 43 | 102 | 66 | 61 | 58 | | | |
| | 60 | 24 | 92 | 43 | 29 | 32 | | | |
| 682883 | 0.6 | 60 | 88 | 73 | 63 | 68 | GalNAc$_3$-3a | PO | 2269 |
| | 2 | 18 | 75 | 38 | 23 | 23 | | | |
| | 6 | 10 | 80 | 35 | 11 | 9 | | | |
| 682884 | 0.6 | 56 | 88 | 78 | 63 | 67 | GalNAc$_3$-7a | PO | 2269 |
| | 2 | 19 | 76 | 44 | 25 | 23 | | | |
| | 6 | 15 | 82 | 35 | 21 | 24 | | | |
| 682885 | 0.6 | 60 | 92 | 77 | 68 | 76 | GalNAc$_3$-10a | PO | 2269 |
| | 2 | 22 | 93 | 58 | 32 | 32 | | | |
| | 6 | 17 | 85 | 37 | 25 | 20 | | | |
| 682886 | 0.6 | 57 | 91 | 70 | 64 | 69 | GalNAc$_3$-13a | PO | 2269 |
| | 2 | 21 | 89 | 50 | 31 | 30 | | | |
| | 6 | 18 | 102 | 41 | 24 | 27 | | | |
| 684057 | 0.6 | 53 | 80 | 69 | 56 | 62 | GalNAc$_3$-19a | $A_d$ | 2270 |
| | 2 | 21 | 92 | 55 | 34 | 30 | | | |
| | 6 | 11 | 82 | 50 | 18 | 13 | | | |

TABLE 86

Transaminase levels, body weight changes, and relative organ weights

| Isis No. | Dosage (mg/kg) | ALT (U/L) | | | | AST (U/L) | | | | Body (% BL) | Liver (% PBS) | Spleen (% PBS) | Kidney (% PBS) | SEQ ID No. |
|---|---|---|---|---|---|---|---|---|---|---|---|---|---|---|
| | | BL | Day 3 | Day 10 | Day 17 | BL | Day 3 | Day 10 | Day 17 | | | | | |
| PBS | n/a | 33 | 34 | 33 | 24 | 58 | 62 | 67 | 52 | 105 | 100 | 100 | 100 | n/a |
| 420915 | 6 | 34 | 33 | 27 | 21 | 64 | 59 | 73 | 47 | 115 | 99 | 89 | 91 | 2269 |
| | 20 | 34 | 30 | 28 | 19 | 64 | 54 | 56 | 42 | 111 | 97 | 83 | 89 | |
| | 60 | 34 | 35 | 31 | 24 | 61 | 58 | 71 | 58 | 113 | 102 | 98 | 95 | |

TABLE 86-continued

Transaminase levels, body weight changes, and relative organ weights

| Isis No. | Dosage (mg/kg) | ALT (U/L) BL | Day 3 | Day 10 | Day 17 | AST (U/L) BL | Day 3 | Day 10 | Day 17 | Body (% BL) | Liver (% PBS) | Spleen (% PBS) | Kidney (% PBS) | SEQ ID No. |
|---|---|---|---|---|---|---|---|---|---|---|---|---|---|---|
| 660261 | 0.6 | 33 | 38 | 28 | 26 | 70 | 71 | 63 | 59 | 111 | 96 | 99 | 92 | 2270 |
|  | 2 | 29 | 32 | 31 | 34 | 61 | 60 | 68 | 61 | 118 | 100 | 92 | 90 |  |
|  | 6 | 29 | 29 | 28 | 34 | 58 | 59 | 70 | 90 | 114 | 99 | 97 | 95 |  |
|  | 20 | 33 | 32 | 28 | 33 | 64 | 54 | 68 | 95 | 114 | 101 | 106 | 92 |  |

TABLE 87

Transaminase levels, body weight changes, and relative organ weights

| Isis No. | Dosage (mg/kg) | ALT (U/L) BL | Day 3 | Day 10 | Day 17 | AST (U/L) BL | Day 3 | Day 10 | Day 17 | Body (% BL) | Liver (% PBS) | Spleen (% PBS) | Kidney (% PBS) | SEQ ID No. |
|---|---|---|---|---|---|---|---|---|---|---|---|---|---|---|
| PBS | n/a | 32 | 34 | 37 | 41 | 62 | 78 | 76 | 77 | 104 | 100 | 100 | 100 | n/a |
| 420915 | 6 | 32 | 30 | 34 | 34 | 61 | 71 | 72 | 66 | 102 | 103 | 102 | 105 | 2269 |
|  | 20 | 41 | 34 | 37 | 33 | 80 | 76 | 63 | 54 | 106 | 107 | 135 | 101 |  |
|  | 60 | 36 | 30 | 32 | 34 | 58 | 81 | 57 | 60 | 106 | 105 | 104 | 99 |  |
| 682883 | 0.6 | 32 | 35 | 38 | 40 | 53 | 81 | 74 | 76 | 104 | 101 | 112 | 95 | 2269 |
|  | 2 | 38 | 39 | 42 | 43 | 71 | 84 | 70 | 77 | 107 | 98 | 116 | 99 |  |
|  | 6 | 35 | 35 | 41 | 38 | 62 | 79 | 103 | 65 | 105 | 103 | 143 | 97 |  |
| 682884 | 0.6 | 33 | 32 | 35 | 34 | 70 | 74 | 75 | 67 | 101 | 100 | 130 | 99 | 2269 |
|  | 2 | 31 | 32 | 38 | 38 | 63 | 77 | 66 | 55 | 104 | 103 | 122 | 100 |  |
|  | 6 | 38 | 32 | 36 | 34 | 65 | 85 | 80 | 62 | 99 | 105 | 129 | 95 |  |
| 682885 | 0.6 | 39 | 26 | 37 | 35 | 63 | 63 | 77 | 59 | 100 | 109 | 109 | 112 | 2269 |
|  | 2 | 30 | 26 | 38 | 40 | 54 | 56 | 71 | 72 | 102 | 98 | 111 | 102 |  |
|  | 6 | 27 | 27 | 34 | 35 | 46 | 52 | 56 | 64 | 102 | 98 | 113 | 96 |  |
| 682886 | 0.6 | 30 | 40 | 34 | 36 | 58 | 87 | 54 | 61 | 104 | 99 | 120 | 101 | 2269 |
|  | 2 | 27 | 26 | 34 | 36 | 51 | 55 | 55 | 69 | 103 | 91 | 105 | 92 |  |
|  | 6 | 40 | 28 | 34 | 37 | 107 | 54 | 61 | 69 | 109 | 100 | 102 | 99 |  |
| 684057 | 0.6 | 35 | 26 | 33 | 39 | 56 | 51 | 51 | 69 | 104 | 99 | 110 | 102 | 2270 |
|  | 2 | 33 | 32 | 31 | 40 | 54 | 57 | 56 | 87 | 103 | 100 | 112 | 97 |  |
|  | 6 | 39 | 33 | 35 | 40 | 67 | 52 | 55 | 92 | 98 | 104 | 121 | 108 |  |

Example 87

Duration of Action In Vivo by Single Doses of Oligonucleotides Targeting TTR Comprising a GalNAc$_3$ Cluster ISIS numbers 420915 and 660261 (see Table 83) were tested in a single dose study for duration of action in mice. ISIS numbers 420915, 682883, and 682885 (see Table 83) were also tested in a single dose study for duration of action in mice.

Treatment

Eight week old, male transgenic mice that express human TTR were each injected subcutaneously once with 100 mg/kg ISIS No. 420915 or 13.5 mg/kg ISIS No. 660261. Each treatment group consisted of 4 animals. Tail bleeds were performed before dosing to determine baseline and at days 3, 7, 10, 17, 24, and 39 following the dose. Plasma TTR protein levels were measured as described in Example 86. The results below are presented as the average percent of plasma TTR levels for each treatment group, normalized to baseline levels.

TABLE 88

Plasma TTR protein levels

| ISIS No. | Dosage (mg/kg) | Time point (days post-dose) | TTR (% baseline) | GalNAc$_3$ Cluster | CM | SEQ ID No. |
|---|---|---|---|---|---|---|
| 420915 | 100 | 3 | 30 | n/a | n/a | 2269 |
|  |  | 7 | 23 |  |  |  |
|  |  | 10 | 35 |  |  |  |
|  |  | 17 | 53 |  |  |  |
|  |  | 24 | 75 |  |  |  |
|  |  | 39 | 100 |  |  |  |
| 660261 | 13.5 | 3 | 27 | GalNAc$_3$-1a | A$_d$ | 2270 |
|  |  | 7 | 21 |  |  |  |
|  |  | 10 | 22 |  |  |  |
|  |  | 17 | 36 |  |  |  |
|  |  | 24 | 48 |  |  |  |
|  |  | 39 | 69 |  |  |  |

Treatment

Female transgenic mice that express human TTR were each injected subcutaneously once with 100 mg/kg ISIS No. 420915, 10.0 mg/kg ISIS No. 682883, or 10.0 mg/kg 682885. Each treatment group consisted of 4 animals. Tail bleeds were performed before dosing to determine baseline and at days 3, 7, 10, 17, 24, and 39 following the dose. Plasma TTR protein levels were measured as described in Example 86. The results below are presented as the average percent of plasma TTR levels for each treatment group, normalized to baseline levels.

TABLE 89

Plasma TTR protein levels

| ISIS No. | Dosage (mg/kg) | Time point (days post-dose) | TTR (% baseline) | GalNAc$_3$ Cluster | CM | SEQ ID No. |
|---|---|---|---|---|---|---|
| 420915 | 100 | 3 | 48 | n/a | n/a | 2269 |
|  |  | 7 | 48 |  |  |  |
|  |  | 10 | 48 |  |  |  |
|  |  | 17 | 66 |  |  |  |
|  |  | 31 | 80 |  |  |  |
| 682883 | 10.0 | 3 | 45 | GalNAc$_3$-3a | PO | 2269 |
|  |  | 7 | 37 |  |  |  |
|  |  | 10 | 38 |  |  |  |
|  |  | 17 | 42 |  |  |  |
|  |  | 31 | 65 |  |  |  |
| 682885 | 10.0 | 3 | 40 | GalNAc$_3$-10a | PO | 2269 |
|  |  | 7 | 33 |  |  |  |
|  |  | 10 | 34 |  |  |  |
|  |  | 17 | 40 |  |  |  |
|  |  | 31 | 64 |  |  |  |

The results in Tables 88 and 89 show that the oligonucleotides comprising a GalNAc conjugate are more potent with a longer duration of action than the parent oligonucleotide lacking a conjugate (ISIS 420915).

Example 88

Splicing Modulation In Vivo by Oligonucleotides Targeting SMN Comprising a GalNAc$_3$ Conjugate The oligonucleotides listed in Table 90 were tested for splicing modulation of human survival of motor neuron (SMN) in mice.

TABLE 90

Modified ASOs targeting SMN

| ISIS No. | Sequences (5' to 3') | GalNAc$_3$ Cluster | CM | SEQ ID No. |
|---|---|---|---|---|
| 387954 | A$_{es}$T$_{es}$T$_{es}$$^m$C$_{es}$A$_{es}$$^m$C$_{es}$T$_{es}$T$_{es}$ T$_{es}$$^m$C$_{es}$A$_{es}$T$_{es}$A$_{es}$A$_{es}$T$_{es}$G$_{es}$ $^m$C$_{es}$T$_{es}$G$_{es}$G$_e$ | n/a | n/a | 2271 |
| 699819 | GalNAc$_3$-7$_{a-o'}$A$_{es}$T$_{es}$T$_{es}$ $^m$C$_{es}$A$_{es}$$^m$C$_{es}$T$_{es}$T$_{es}$T$_{es}$$^m$C$_{es}$ A$_{es}$T$_{es}$A$_{es}$A$_{es}$T$_{es}$G$_{es}$$^m$C$_{es}$T$_{es}$ G$_{es}$G$_e$ | GalNAc$_3$-7a | PO | 2271 |
| 699821 | GalNAc$_3$-7$_{a-o'}$A$_{es}$T$_{es}$T$_{es}$ $^m$C$_{es}$A$_{es}$$^m$C$_{es}$T$_{es}$T$_{es}$T$_{es}$$^m$C$_{es}$ A$_{es}$T$_{es}$A$_{es}$A$_{es}$A$_{eo}$T$_{eo}$G$_{eo}$$^m$C$_{eo}$ T$_{es}$G$_{es}$G$_e$ | GalNAc$_3$-7a | PO | 2271 |
| 700000 | A$_{es}$T$_{es}$T$_{es}$$^m$C$_{es}$A$_{es}$$^m$C$_{es}$T$_{es}$ T$_{es}$T$_{es}$$^m$C$_{es}$A$_{es}$T$_{es}$A$_{es}$A$_{es}$T$_{es}$ G$_{es}$$^m$C$_{es}$T$_{es}$G$_{es}$G$_{eo}$A$_{do'}$-GalNAc$_3$-1$_a$ | GalNAc$_3$-1a | A$_d$ | 2272 |
| 703421 | X-ATT$^m$CA$^m$CTTT$^m$CATAA TG$^m$CTGG | n/a | n/a | 2271 |
| 703422 | GalNAc$_3$-7$_b$-X-ATT$^m$CA$^m$C TTT$^m$CATAATG$^m$CTGG | GalNAc$_3$-7b | n/a | 2271 |

The structure of GalNAc$_3$-7$_a$ was shown previously in Example 48. "X" indicates a 5' primary amine generated by Gene Tools (Philomath, Oreg.), and GalNAc$_3$-7$_b$ indicates the structure of GalNAc$_3$-7$_a$ lacking the —NH—C$_6$—O portion of the linker as shown below:

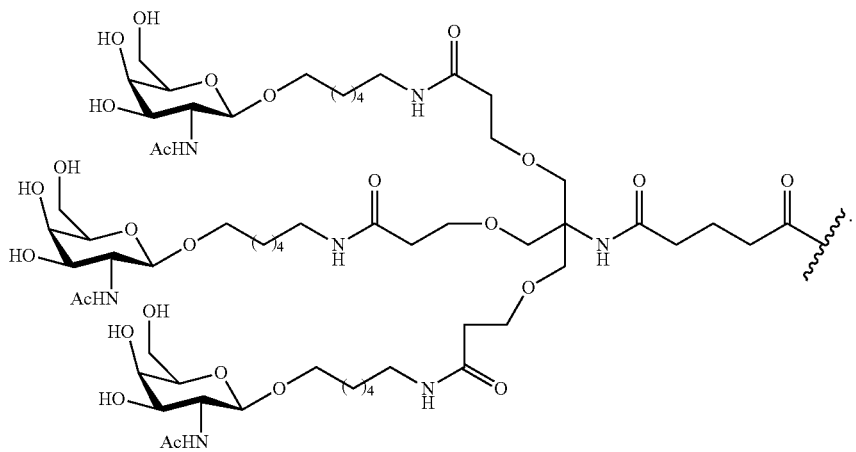

ISIS numbers 703421 and 703422 are morpholino oligonucleotides, wherein each nucleotide of the two oligonucleotides is a morpholino nucleotide.

Treatment

Six week old transgenic mice that express human SMN were injected subcutaneously once with an oligonucleotide listed in Table 91 or with saline. Each treatment group consisted of 2 males and 2 females. The mice were sacrificed 3 days following the dose to determine the liver human SMN mRNA levels both with and without exon 7 using real-time PCR according to standard protocols. Total RNA was measured using Ribogreen reagent. The SMN mRNA levels were normalized to total mRNA, and further normalized to the averages for the saline treatment group. The resulting average ratios of SMN mRNA including exon 7 to SMN mRNA missing exon 7 are shown in Table 91. The results show that fully modified oligonucleotides that modulate splicing and comprise a GalNAc conjugate are significantly more potent in altering splicing in the liver than the parent oligonucleotides lacking a GlaNAc conjugate. Furthermore, this trend is maintained for multiple modification chemistries, including 2'-MOE and morpholino modified oligonucleotides.

TABLE 91

Effect of oligonucleotides targeting human SMN in vivo

| ISIS No. | Dose (mg/kg) | +Exon 7/−Exon 7 | GalNAc$_3$ Cluster | CM | SEQ ID No. |
|---|---|---|---|---|---|
| Saline | n/a | 1.00 | n/a | n/a | n/a |
| 387954 | 32 | 1.65 | n/a | n/a | 2271 |
| 387954 | 288 | 5.00 | n/a | n/a | 2271 |
| 699819 | 32 | 7.84 | GalNAc$_3$-7a | PO | 2271 |
| 699821 | 32 | 7.22 | GalNAc$_3$-7a | PO | 2271 |
| 700000 | 32 | 6.91 | GalNAc$_3$-1a | $A_d$ | 2272 |
| 703421 | 32 | 1.27 | n/a | n/a | 2271 |
| 703422 | 32 | 4.12 | GalNAc$_3$-7b | n/a | 2271 |

Example 89

Antisense Inhibition In Vivo by Oligonucleotides Targeting Apolipoprotein A (Apo(a)) Comprising a GalNAc$_3$ Conjugate The oligonucleotides listed in Table 92 below were tested in a study for dose-dependent inhibition of Apo(a) in transgenic mice.

TABLE 92

Modified ASOs targeting Apo(a)

| ISIS No. | Sequence (5' to 3') | GalNAc$_3$ Cluster | CM | SEQ ID No. |
|---|---|---|---|---|
| 494372 | $T_{es}G_{es}{}^mC_{es}T_{es}{}^mC_{es}{}^mC_{ds}G_{ds}T_{ds}T_{ds}G_{ds}G_{ds}T_{ds}G_{ds}{}^mC_{ds}T_{ds}T_{es}G_{es}T_{es}T_{es}{}^mC_e$ | n/a | n/a | 2281 |
| 681287 | GalNAc$_3$-7$_{a-o}$,$T_{es}G_{es}{}^mC_{es}T_{es}{}^mC_{es}{}^mC_{ds}G_{ds}T_{ds}T_{ds}G_{ds}G_{ds}T_{ds}G_{ds}{}^mC_{ds}T_{ds}T_{es}G_{es}T_{es}T_{es}{}^mC_e$ | GalNAc$_3$-7a | PO | 2281 |

Treatment

Eight week old, female C57BL/6 mice (Jackson Laboratory, Bar Harbor, Me.) were each injected subcutaneously once per week at a dosage shown below, for a total of six doses, with an oligonucleotide listed in Table 92 or with PBS. Each treatment group consisted of 3-4 animals. Tail bleeds were performed the day before the first dose and weekly following each dose to determine plasma Apo(a) protein levels. The mice were sacrificed two days following the final administration. Apo(a) liver mRNA levels were determined using real-time PCR and RIBOGREEN® RNA quantification reagent (Molecular Probes, Inc. Eugene, Oreg.) according to standard protocols. Apo(a) plasma protein levels were determined using ELISA, and liver transaminase levels were determined. The mRNA and plasma protein results in Table 93 are presented as the treatment group average percent relative to the PBS treated group. Plasma protein levels were further normalized to the baseline (BL) value for the PBS group. Average absolute transaminase levels and body weights (% relative to baseline averages) are reported in Table 94.

As illustrated in Table 93, treatment with the oligonucleotides lowered Apo(a) liver mRNA and plasma protein levels in a dose-dependent manner. Furthermore, the oligonucleotide comprising the GalNAc conjugate was significantly more potent with a longer duration of action than the parent oligonucleotide lacking a GalNAc conjugate. As illustrated in Table 94, transaminase levels and body weights were unaffected by the oligonucleotides, indicating that the oligonucleotides were well tolerated.

TABLE 93

Apo(a) liver mRNA and plasma protein levels

| ISIS No. | Dosage (mg/kg) | Apo(a) mRNA (% PBS) | Apo(a) plasma protein (% PBS) | | | | | |
|---|---|---|---|---|---|---|---|---|
| | | | BL | Week 1 | Week 2 | Week 3 | Week 4 | Week 5 | Week 6 |
| PBS | n/a | 100 | 100 | 120 | 119 | 113 | 88 | 121 | 97 |
| 494372 | 3 | 80 | 84 | 89 | 91 | 98 | 87 | 87 | 79 |
| | 10 | 30 | 87 | 72 | 76 | 71 | 57 | 59 | 46 |
| | 30 | 5 | 92 | 54 | 28 | 10 | 7 | 9 | 7 |
| 681257 | 0.3 | 75 | 79 | 76 | 89 | 98 | 71 | 94 | 78 |
| | 1 | 19 | 79 | 88 | 66 | 60 | 54 | 32 | 24 |
| | 3 | 2 | 82 | 52 | 17 | 7 | 4 | 6 | 5 |
| | 10 | 2 | 79 | 17 | 6 | 3 | 2 | 4 | 5 |

TABLE 94

| ISIS No. | Dosage (mg/kg) | ALT (U/L) | AST (U/L) | Body weight (% baseline) |
|---|---|---|---|---|
| PBS | n/a | 37 | 54 | 103 |
| 494372 | 3 | 28 | 68 | 106 |
|  | 10 | 22 | 55 | 102 |
|  | 30 | 19 | 48 | 103 |
| 681257 | 0.3 | 30 | 80 | 104 |
|  | 1 | 26 | 47 | 105 |
|  | 3 | 29 | 62 | 102 |
|  | 10 | 21 | 52 | 107 | relative to the average for the PBS group. Plasma protein levels are the average values relative to the average value for the PBS group at baseline. "BL" indicates baseline, measurements that were taken just prior to the first dose. As illustrated in Table 96, treatment with antisense oligonucleotides lowered TTR expression levels in a dose-dependent manner. The oligonucleotides comprising a GalNAc conjugate were more potent than the parent lacking a GalNAc conjugate (ISIS 420915), and oligonucleotides comprising a phosphodiester or deoxyadenosine cleavable moiety showed significant improvements in potency compared to the parent lacking a conjugate (see ISIS numbers 682883 and 666943 vs 420915 and see Examples 86 and 87).

TABLE 95

Oligonucleotides targeting human TTR

| ISIS No. | Sequences | Linkages | GalNAc cluster | CM | SEQ ID No. |
|---|---|---|---|---|---|
| 420915 | $T_{es}{}^mC_{es}T_{es}T_{es}G_{es}G_{ds}T_{ds}T_{ds}A_{ds}{}^mC_{ds}A_{ds}T_{ds}$ $G_{ds}A_{ds}A_{ds}A_{es}T_{es}{}^mC_{es}{}^mC_{es}{}^mC_e$ | PS | n/a | n/a | 2269 |
| 682883 | GalNAc$_3$-3$_{a-o}$,$T_{es}{}^mC_{eo}T_{eo}T_{eo}G_{eo}G_{ds}T_{ds}$ $T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-3a | PO | 2269 |
| 666943 | GalNAc$_3$-3$_{a-o}$,$A_{do}T_{es}{}^mC_{eo}T_{eo}T_{eo}G_{eo}G_{ds}T_{ds}$ $T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-3a | A$_d$ | 2273 |
| 682887 | GalNAc$_3$-7$_{a-o}$,$A_{do}T_{es}{}^mC_{eo}T_{eo}T_{eo}G_{eo}G_{ds}T_{ds}$ $T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-7a | A$_d$ | 2273 |
| 682888 | GalNAc$_3$-10$_{a-o}$,$A_{do}T_{es}{}^mC_{eo}T_{eo}T_{eo}G_{eo}G_{ds}T_{ds}$ $T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-10a | A$_d$ | 2273 |
| 682889 | GalNAc$_3$-13$_{a-o}$,$A_{do}T_{es}{}^mC_{eo}T_{eo}T_{eo}G_{eo}G_{ds}T_{ds}$ $T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-13a | A$_d$ | 2273 |

Example 90

Antisense Inhibition In Vivo by Oligonucleotides Targeting TTR Comprising a GalNAc$_3$ Cluster Oligonucleotides listed in Table 95 below were tested in a dose-dependent study for antisense inhibition of human transthyretin (TTR) in transgenic mice that express the human TTR gene.

Treatment

TTR transgenic mice were each injected subcutaneously once per week for three weeks, for a total of three doses, with an oligonucleotide and dosage listed in Table 96 or with PBS. Each treatment group consisted of 4 animals. Prior to the first dose, a tail bleed was performed to determine plasma TTR protein levels at baseline (BL). The mice were sacrificed 72 hours following the final administration. TTR protein levels were measured using a clinical analyzer (AU480, Beckman Coulter, CA). Real-time PCR and RIBOGREEN® RNA quantification reagent (Molecular Probes, Inc. Eugene, Oreg.) were used according to standard protocols to determine liver human TTR mRNA levels. The results presented in Table 96 are the average values for each treatment group. The mRNA levels are the average values The legend for Table 95 can be found in Example 74. The structure of GalNAc$_3$-3$_a$ was shown in Example 39. The 6structure of GalNAc$_3$-7$_a$ was shown in Example 48. The structure of GalNAc$_3$-10$_a$ was shown in Example 46. The structure of GalNAc$_3$-13$_a$ was shown in Example 62.

TABLE 96

Antisense inhibition of human TTR in vivo

| Isis No. | Dosage (mg/kg) | TTR mRNA (% PBS) | TTR protein (% BL) | GalNAc cluster | CM |
|---|---|---|---|---|---|
| PBS | n/a | 100 | 124 | n/a | n/a |
| 420915 | 6 | 69 | 114 | n/a | n/a |
|  | 20 | 71 | 86 |  |  |
|  | 60 | 21 | 36 |  |  |
| 682883 | 0.6 | 61 | 73 | GalNAc$_3$-3a | PO |
|  | 2 | 23 | 36 |  |  |
|  | 6 | 18 | 23 |  |  |
| 666943 | 0.6 | 74 | 93 | GalNAc$_3$-3a | A$_d$ |
|  | 2 | 33 | 57 |  |  |
|  | 6 | 17 | 22 |  |  |
| 682887 | 0.6 | 60 | 97 | GalNAc$_3$-7a | A$_d$ |
|  | 2 | 36 | 49 |  |  |
|  | 6 | 12 | 19 |  |  |
| 682888 | 0.6 | 65 | 92 | GalNAc$_3$-10a | A$_d$ |
|  | 2 | 32 | 46 |  |  |
|  | 6 | 17 | 22 |  |  |
| 682889 | 0.6 | 72 | 74 | GalNAc$_3$-13a | A$_d$ |
|  | 2 | 38 | 45 |  |  |
|  | 6 | 16 | 18 |  |  |

Example 91

Antisense Inhibition In Vivo by Oligonucleotides Targeting Factor VII Comprising a GalNAc$_3$ Conjugate in Non-human Primates Oligonucleotides listed in Table 97 below were tested in a non-terminal, dose escalation study for antisense inhibition of Factor VII in monkeys.

Treatment

Non-naïve monkeys were each injected subcutaneously on days 0, 15, and 29 with escalating doses of an oligonucleotide listed in Table 97 or with PBS. Each treatment group consisted of 4 males and 1 female. Prior to the first dose and at various time points thereafter, blood draws were performed to determine plasma Factor VII protein levels. Factor VII protein levels were measured by ELISA. The results presented in Table 98 are the average values for each treatment group relative to the average value for the PBS group at baseline (BL), the measurements taken just prior to the first dose. As illustrated in Table 98, treatment with antisense oligonucleotides lowered Factor VII expression levels in a dose-dependent manner, and the oligonucleotide comprising the GalNAc conjugate was significantly more potent in monkeys compared to the oligonucleotide lacking a GalNAc conjugate.

TABLE 97

Oligonucleotides targeting human TTR

| ISIS No. | Sequences | Linkages | GalNAc cluster | CM | SEQ ID No. |
|---|---|---|---|---|---|
| 407935 | A$_{es}$T$_{es}$G$_{es}$$^m$C$_{es}$A$_{es}$T$_{ds}$G$_{ds}$G$_{ds}$T$_{ds}$G$_{ds}$A$_{ds}$T$_{ds}$G$_{ds}$$^m$C$_{ds}$T$_{ds}$T$_{es}$$^m$C$_{es}$T$_{es}$G$_{es}$A$_e$ | PS | n/a | n/a | 2274 |
| 686892 | GalNAc$_3$-10$_{a-o}$,A$_{es}$T$_{es}$G$_{es}$$^m$C$_{es}$A$_{es}$T$_{ds}$G$_{ds}$G$_{ds}$T$_{ds}$G$_{ds}$A$_{ds}$T$_{ds}$G$_{ds}$$^m$C$_{ds}$T$_{ds}$T$_{es}$$^m$C$_{es}$T$_{es}$G$_{es}$A$_e$ | PS | GalNAc$_3$-10a | PO | 2274 |

The legend for Table 97 can be found in Example 74. The structure of GalNAc$_3$-10$_a$ was shown in Example 46.

TABLE 98

Factor VII plasma protein levels

| ISIS No. | Day | Dose (mg/kg) | Factor VII (% BL) |
|---|---|---|---|
| 407935 | 0 | n/a | 100 |
|  | 15 | 10 | 87 |
|  | 22 | n/a | 92 |
|  | 29 | 30 | 77 |
|  | 36 | n/a | 46 |
|  | 43 | n/a | 43 |
| 686892 | 0 | 3 | 100 |
|  | 15 | 10 | 56 |
|  | 22 | n/a | 29 |
|  | 29 | 30 | 19 |
|  | 36 | n/a | 15 |
|  | 43 | n/a | 11 |

Example 92

Antisense Inhibition in Primary Hepatocytes by Antisense Oligonucleotides Targeting ApoCIII Comprising a GalNAc$_3$ Conjugate Primary mouse hepatocytes were seeded in 96-well plates at 15,000 cells per well, and the oligonucleotides listed in Table 99, targeting mouse ApoC-III, were added at 0.46, 1.37, 4.12, or 12.35, 37.04, 111.11, or 333.33 nM or 1.00 µM. After incubation with the oligonucleotides for 24 hours, the cells were lysed and total RNA was purified using RNeasy (Qiagen). ApoC-III mRNA levels were determined using real-time PCR and RIBOGREEN® RNA quantification reagent (Molecular Probes, Inc.) according to standard protocols. IC$_{50}$ values were determined using Prism 4 software (GraphPad). The results show that regardless of whether the cleavable moiety was a phosphodiester or a phosphodiester-linked deoxyadenosine, the oligonucleotides comprising a GalNAc conjugate were significantly more potent than the parent oligonucleotide lacking a conjugate.

TABLE 99

Inhibition of mouse APOC-III expression in mouse primary hepatocytes

| ISIS No. | Sequence (5' to 3') | CM | IC$_{50}$ (nM) | SEQ ID No. |
|---|---|---|---|---|
| 440670 | $^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$A$_{es}$G$_{es}$$^m$C$_{es}$A$_e$ | n/a | 13.20 | 2275 |
| 661180 | $^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$A$_{es}$G$_{es}$$^m$C$_{es}$A$_{eo}$A$_{do}$,-GalNAc$_3$-1$_a$ | A$_d$ | 1.40 | 2276 |
| 680771 | GalNAc$_3$-3$_{a-o}$,$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$A$_{es}$G$_{es}$$^m$C$_{es}$A$_e$ | PO | 0.70 | 2275 |
| 680772 | GalNAc$_3$-7$_{a-o}$,$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$A$_{es}$G$_{es}$$^m$C$_{es}$A$_e$ | PO | 1.70 | 2275 |
| 680773 | GalNAc$_3$-10$_{a-o}$,$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$A$_{es}$G$_{es}$$^m$C$_{es}$A$_e$ | PO | 2.00 | 2275 |
| 680774 | GalNAc$_3$-13$_{a-o}$,$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$A$_{es}$G$_{es}$$^m$C$_{es}$A$_e$ | PO | 1.50 | 2275 |
| 681272 | GalNAc$_3$-3$_{a-o}$,$^m$C$_{es}$A$_{eo}$G$_{eo}$$^m$C$_{eo}$T$_{eo}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{eo}$A$_{eo}$G$_{es}$$^m$C$_{es}$A$_e$ | PO | <0.46 | 2275 |

TABLE 99-continued

Inhibition of mouse APOC-III expression in mouse primary hepatocytes

| ISIS No. | Sequence (5' to 3') | CM | IC$_{50}$ (nM) | SEQ ID No. |
|---|---|---|---|---|
| 681273 | GalNAc$_3$-3$_{a-o}$,A$_{do}$,$^m$C$_{es}$A$_{es}$G$_{es}$$^m$C$_{es}$A$_d$ T$_{es}$T$_{ds}$T$_{ds}$A$_{ds}$T$_{ds}$T$_{ds}$A$_{ds}$G$_{ds}$G$_{ds}$G$_{ds}$ A$_{ds}$$^m$C$_{es}$A$_{es}$G$_{es}$$^m$C$_{es}$A$_e$ | | 1.10 | 2277 |
| 683733 | $^m$C$_{es}$A$_{es}$G$_{es}$$^m$C$_{es}$T$_{es}$T$_{ds}$T$_{ds}$A$_{ds}$T$_{ds}$T$_{ds}$ A$_{ds}$G$_{ds}$G$_{ds}$G$_{ds}$A$_{ds}$$^m$C$_{es}$A$_{es}$G$_{es}$$^m$C$_{es}$A$_{eo}$ A$_{do}$,-GalNAc$_3$-19$_a$ | A$_d$ | 2.50 | 2276 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, GalNAc$_3$-13$_a$ was shown in Example 62, and GalNAc$_3$-19$_a$ was shown in Example 70.

Example 93

Antisense Inhibition In Vivo by Oligonucleotides Targeting SRB-1 Comprising Mixed Wings and a 5'-GalNAc$_3$ Conjugate The oligonucleotides listed in Table 100 were tested in a dose-dependent study for antisense inhibition of SRB-1 in mice.

TABLE 100

Modified ASOs targeting SRB-1

| ISIS No. | Sequences (5' to 3') | GalNAC$_3$ Cluster | CM | SEQ ID No. |
|---|---|---|---|---|
| 449093 | T$_{ks}$T$_{ks}$$^m$C$_{ks}$A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{ks}$$^m$C$_{ks}$$^m$C$_k$ | n/a | n/a | 2278 |
| 699806 | GalNAc$_3$-3$_{a-o}$,T$_{ks}$T$_{ks}$$^m$C$_{ks}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{ks}$$^m$ C$_{ks}$$^m$C$_k$ | GalNAc$_3$-3a | PO | 2278 |
| 699807 | GalNAc$_3$-7$_{a-o}$,T$_{ks}$T$_{ks}$$^m$C$_{ks}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{ks}$$^m$ C$_{ds}$$^m$C$_k$ | GalNAc$_3$-7a | PO | 2278 |
| 699809 | GalNAc$_3$-7$_{a-o}$,T$_{ks}$T$_{ks}$$^m$C$_{ks}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{es}$$^m$ C$_{es}$$^m$C$_e$ | GalNAc$_3$-7a | PO | 2278 |
| 699811 | GalNAc$_3$-7$_{a-o}$,T$_{es}$T$_{es}$$^m$C$_{es}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{ks}$$^m$ C$_{ks}$$^m$C$_k$ | GalNAc$_3$-7a | PO | 2278 |
| 699813 | GalNAc$_3$-7$_{a-o}$,T$_{ks}$T$_{ds}$$^m$C$_{ks}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{ks}$$^m$ C$_{ds}$$^m$C$_k$ | GalNAc$_3$-7a | PO | 2278 |
| 699815 | GalNAc$_3$-7$_{a-o}$,T$_{es}$T$_{ks}$$^m$C$_{ks}$A$_{ds}$G$_{ds}$ T$_{ds}$$^m$C$_{ds}$A$_{ds}$T$_{ds}$G$_{ds}$A$_{ds}$$^m$C$_{ds}$T$_{ds}$T$_{ks}$$^m$ C$_{ks}$$^m$C$_e$ | GalNAc$_3$-7a | PO | 2278 |

The structure of GalNAc$_3$-3$_a$ was shown previously in Example 39, and the structure of GalNAc$_3$-7a was shown previously in Example 48. Subscripts: "e" indicates 2'-MOE modified nucleoside; "d" indicates β-D-2'-deoxyribonucleoside; "k" indicates 6'-(S)—CH$_3$ bicyclic nucleoside (cEt); "s" indicates phosphorothioate internucleoside linkages (PS); "o" indicates phosphodiester internucleoside linkages (PO). Superscript "m" indicates 5-methylcytosines.

Treatment

Six to eight week old C57BL/6 mice (Jackson Laboratory, Bar Harbor, Me.) were injected subcutaneously once at the dosage shown below with an oligonucleotide listed in Table 100 or with saline. Each treatment group consisted of 4 animals. The mice were sacrificed 72 hours following the final administration. Liver SRB-1 mRNA levels were measured using real-time PCR. SRB-1 mRNA levels were normalized to cyclophilin mRNA levels according to standard protocols. The results are presented as the average percent of SRB-1 mRNA levels for each treatment group relative to the saline control group. As illustrated in Table 101, treatment with antisense oligonucleotides lowered SRB-1 mRNA levels in a dose-dependent manner, and the gapmer oligonucleotides comprising a GalNAc conjugate and having wings that were either full cEt or mixed sugar modifications were significantly more potent than the parent oligonucleotide lacking a conjugate and comprising full cEt modified wings.

Body weights, liver transaminases, total bilirubin, and BUN were also measured, and the average values for each treatment group are shown in Table 101. Body weight is shown as the average percent body weight relative to the baseline body weight (% BL) measured just prior to the oligonucleotide dose.

TABLE 101

SRB-1 mRNA, ALT, AST, BUN, and total bilirubin levels and body weights

| ISIS No. | Dosage (mg/kg) | SRB-1 mRNA (% PBS) | ALT (U/L) | AST (U/L) | Bil | BUN | Body weight (% BL) |
|---|---|---|---|---|---|---|---|
| PBS | n/a | 100 | 31 | 84 | 0.15 | 28 | 102 |
| 449093 | 1 | 111 | 18 | 48 | 0.17 | 31 | 104 |
| | 3 | 94 | 20 | 43 | 0.15 | 26 | 103 |
| | 10 | 36 | 19 | 50 | 0.12 | 29 | 104 |

TABLE 101-continued

SRB-1 mRNA, ALT, AST, BUN, and total bilirubin levels and body weights

| ISIS No. | Dosage (mg/kg) | SRB-1 mRNA (% PBS) | ALT (U/L) | AST (U/L) | Bil | BUN | Body weight (% BL) |
|---|---|---|---|---|---|---|---|
| 699806 | 0.1 | 114 | 23 | 58 | 0.13 | 26 | 107 |
|  | 0.3 | 59 | 21 | 45 | 0.12 | 27 | 108 |
|  | 1 | 25 | 30 | 61 | 0.12 | 30 | 104 |
| 699807 | 0.1 | 121 | 19 | 41 | 0.14 | 25 | 100 |
|  | 0.3 | 73 | 23 | 56 | 0.13 | 26 | 105 |
|  | 1 | 24 | 22 | 69 | 0.14 | 25 | 102 |
| 699809 | 0.1 | 125 | 23 | 57 | 0.14 | 26 | 104 |
|  | 0.3 | 70 | 20 | 49 | 0.10 | 25 | 105 |
|  | 1 | 33 | 34 | 62 | 0.17 | 25 | 107 |
| 699811 | 0.1 | 123 | 48 | 77 | 0.14 | 24 | 106 |
|  | 0.3 | 94 | 20 | 45 | 0.13 | 25 | 101 |
|  | 1 | 66 | 57 | 104 | 0.14 | 24 | 107 |
| 699813 | 0.1 | 95 | 20 | 58 | 0.13 | 28 | 104 |
|  | 0.3 | 98 | 22 | 61 | 0.17 | 28 | 105 |
|  | 1 | 49 | 19 | 47 | 0.11 | 27 | 106 |
| 699815 | 0.1 | 93 | 30 | 79 | 0.17 | 25 | 105 |
|  | 0.3 | 64 | 30 | 61 | 0.12 | 26 | 105 |
|  | 1 | 24 | 18 | 41 | 0.14 | 25 | 106 |

Example 94

Antisense Inhibition In Vivo by Oligonucleotides Targeting SRB-1 Comprising 2'-Sugar Modifications and a 5'-GalNAc$_3$ Conjugate The oligonucleotides listed in Table 102 were tested in a dose-dependent study for antisense inhibition of SRB-1 in mice.

TABLE 102

Modified ASOs targeting SRB-1

| ISIS No. | Sequences (5' to 3') | GalNAc$_3$ Cluster | CM | SEQ ID No. |
|---|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | n/a | n/a | 2256 |
| 700989 | G$_{ms}$C$_{ms}$U$_{ms}$U$_{ms}$C$_{ms}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$U$_{ms}$C$_{ms}$C$_{ms}$U$_{ms}$U$_{m}$ | n/a | n/a | 2279 |
| 666904 | GalNAc$_3$-3$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{e}$ | GalNAc$_3$-3a | PO | 2256 |
| 700991 | GalNAc$_3$-7$_{a-o}$,G$_{ms}$C$_{ms}$U$_{ms}$U$_{ms}$C$_{ms}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$U$_{ms}$C$_{ms}$C$_{ms}$U$_{ms}$U$_{m}$ | GalNAc$_3$-7a | PO | 2279 |

Subscript "m" indicates a 2'-O-methyl modified nucleoside. See Example 74 for complete table legend. The structure of GalNAc$_3$-3$_a$ was shown previously in Example 39, and the structure of GalNAc$_3$-7a was shown previously in Example 48.

Treatment

The study was completed using the protocol described in Example 93. Results are shown in Table 103 below and show that both the 2'-MOE and 2'-OMe modified oligonucleotides comprising a GalNAc conjugate were significantly more potent than the respective parent oligonucleotides lacking a conjugate. The results of the body weights, liver transaminases, total bilirubin, and BUN measurements indicated that the compounds were all well tolerated.

TABLE 103

SRB-1 mRNA

| ISIS No. | Dosage (mg/kg) | SRB-1 mRNA (% PBS) |
|---|---|---|
| PBS | n/a | 100 |
| 353382 | 5 | 116 |
|  | 15 | 58 |
|  | 45 | 27 |
| 700989 | 5 | 120 |
|  | 15 | 92 |
|  | 45 | 46 |
| 666904 | 1 | 98 |
|  | 3 | 45 |
|  | 10 | 17 |
| 700991 | 1 | 118 |
|  | 3 | 63 |
|  | 10 | 14 |

Example 95

Antisense Inhibition In Vivo by Oligonucleotides Targeting SRB-1 Comprising Bicyclic Nucleosides and a 5'-GalNAc$_3$ Conjugate The oligonucleotides listed in Table 104 were tested in a dose-dependent study for antisense inhibition of SRB-1 in mice.

TABLE 104

Modified ASOs targeting SRB-1

| ISIS No. | Sequences (5' to 3') | GalNAc$_3$ Cluster | CM | SEQ ID No. |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{k}$ | n/a | n/a | 2250 |
| 666905 | GalNAc$_3$-3$_{a-o}$,T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{k}$ | GalNAc$_3$-3$_a$ | PO | 2250 |
| 699782 | GalNAc$_3$-7$_{a-o}$,T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{k}$ | GalNAc$_3$-7$_a$ | PO | 2250 |
| 699783 | GalNAc$_3$-3$_{a-o}$,T$_{ls}$$^m$C$_{ls}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ls}$$^m$C$_{l}$ | GalNAc$_3$-3$_a$ | PO | 2250 |
| 653621 | T$_{ls}$$^m$C$_{ls}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ls}$$^m$C$_{l}$A$_{do}$,-GalNAc$_3$-1$_a$ | GalNAc$_3$-A$_d$ 1$_a$ | | 2251 |
| 439879 | T$_{gs}$$^m$C$_{gs}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{gs}$$^m$C$_{g}$ | n/a | n/a | 2250 |
| 699789 | GalNAc$_3$-3$_{a-o}$,T$_{gs}$$^m$C$_{gs}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{gs}$$^m$C$_{g}$ | GalNAc$_3$-3$_a$ | PO | 2250 |

Subscript "g" indicates a fluoro-HNA nucleoside, subscript "l" indicates a locked nucleoside comprising a 2'-O—CH$_2$-4' bridge. See the Example 74 table legend for other abbreviations. The structure of GalNAc$_3$-1$_a$ was shown previously in Example 9, the structure of GalNAc$_3$-3$_a$ was shown previously in Example 39, and the structure of GalNAc$_3$-7a was shown previously in Example 48.

Treatment

The study was completed using the protocol described in Example 93. Results are shown in Table 105 below and show that oligonucleotides comprising a GalNAc conjugate and various bicyclic nucleoside modifications were significantly more potent than the parent oligonucleotide lacking a conjugate and comprising bicyclic nucleoside modifications. Furthermore, the oligonucleotide comprising a GalNAc conjugate and fluoro-HNA modifications was significantly more potent than the parent lacking a conjugate and comprising fluoro-HNA modifications. The results of the body weights, liver transaminases, total bilirubin, and BUN measurements indicated that the compounds were all well tolerated.

TABLE 105

SRB-1 mRNA, ALT, AST, BUN, and total bilirubin levels and body weights

| ISIS No. | Dosage (mg/kg) | SRB-1 mRNA (% PBS) |
|---|---|---|
| PBS | n/a | 100 |
| 440762 | 1 | 104 |
|  | 3 | 65 |
|  | 10 | 35 |
| 666905 | 0.1 | 105 |
|  | 0.3 | 56 |
|  | 1 | 18 |
| 699782 | 0.1 | 93 |
|  | 0.3 | 63 |
|  | 1 | 15 |
| 699783 | 0.1 | 105 |
|  | 0.3 | 53 |
|  | 1 | 12 |
| 653621 | 0.1 | 109 |
|  | 0.3 | 82 |
|  | 1 | 27 |
| 439879 | 1 | 96 |
|  | 3 | 77 |
|  | 10 | 37 |
| 699789 | 0.1 | 82 |
|  | 0.3 | 69 |
|  | 1 | 26 |

Example 96

Plasma Protein Binding of Antisense Oligonucleotides Comprising a GalNAc$_3$ Conjugate Group Oligonucleotides listed in Table 70 targeting ApoC-III and oligonucleotides in Table 106 targeting Apo(a) were tested in an ultra-filtration assay in order to assess plasma protein binding.

TABLE 106

Modified oligonucleotides targeting Apo(a)

| ISIS No. | Sequences (5' to 3') | GalNAc$_3$ Cluster | CM | SEQ ID No. |
|---|---|---|---|---|
| 494372 | T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_e$ | n/a | n/a | 2281 |
| 693401 | T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_e$ | n/a | n/a | 2281 |
| 681251 | GalNAc$_3$-7$_{a-o'}$T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_e$ | GalNAc$_3$-7$_a$ | PO | 2281 |
| 681257 | GalNAc$_3$-7$_{a-o'}$T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_e$ | GalNAc$_3$-7$_a$ | PO | 2281 |

See the Example 74 for table legend. The structure of GalNAc$_3$-7a was shown previously in Example 48.

Ultrafree-MC ultrafiltration units (30,000 NMWL, low-binding regenerated cellulose membrane, Millipore, Bedford, Mass.) were pre-conditioned with 300 μL of 0.5% Tween 80 and centrifuged at 2000 g for 10 minutes, then with 300 μL of a 300 μg/mL solution of a control oligonucleotide in H$_2$O and centrifuged at 2000 g for 16 minutes. In order to assess non-specific binding to the filters of each test oligonucleotide from Tables 70 and 106 to be used in the studies, 300 μL of a 250 ng/mL solution of oligonucleotide in H$_2$O at pH 7.4 was placed in the pre-conditioned filters and centrifuged at 2000 g for 16 minutes. The unfiltered and filtered samples were analyzed by an ELISA assay to determine the oligonucleotide concentrations. Three replicates were used to obtain an average concentration for each sample. The average concentration of the filtered sample relative to the unfiltered sample is used to determine the percent of oligonucleotide that is recovered through the filter in the absence of plasma (% recovery).

Frozen whole plasma samples collected in K3-EDTA from normal, drug-free human volunteers, cynomolgus monkeys, and CD-1 mice, were purchased from Bioreclamation LLC (Westbury, N.Y.). The test oligonucleotides were added to 1.2 mL aliquots of plasma at two concentrations (5 and 150 μg/mL). An aliquot (300 μL) of each spiked plasma sample was placed in a pre-conditioned filter unit and incubated at 37° C. for 30 minutes, immediately followed by centrifugation at 2000 g for 16 minutes. Aliquots of filtered and unfiltered spiked plasma samples were analyzed by an ELISA to determine the oligonucleotide concentration in each sample. Three replicates per concentration were used to determine the average percentage of bound and unbound oligonucleotide in each sample. The average concentration of the filtered sample relative to the concentration of the unfiltered sample is used to determine the percent of oligonucleotide in the plasma that is not bound to plasma proteins (% unbound). The final unbound oligonucleotide values are corrected for non-specific binding by dividing the % unbound by the % recovery for each oligonucleotide. The final % bound oligonucleotide values are determined by subtracting the final % unbound values from 100. The results are shown in Table 107 for the two concentrations of oligonucleotide tested (5 and 150 μg/mL) in each species of plasma. The results show that GalNAc conjugate groups do not have a significant impact on plasma protein binding. Furthermore, oligonucleotides with full PS internucleoside linkages and mixed PO/PS linkages both bind plasma proteins, and those with full PS linkages bind plasma proteins to a somewhat greater extent than those with mixed PO/PS linkages.

TABLE 107

Percent of modified oligonucleotide bound to plasma proteins

| | Human plasma | | Monkey plasma | | Mouse plasma | |
|---|---|---|---|---|---|---|
| ISIS No. | 5 μg/mL | 150 μg/mL | 5 μg/mL | 150 μg/mL | 5 μg/mL | 150 μg/mL |
| 304801 | 99.2 | 98.0 | 99.8 | 99.5 | 98.1 | 97.2 |
| 663083 | 97.8 | 90.9 | 99.3 | 99.3 | 96.5 | 93.0 |
| 674450 | 96.2 | 97.0 | 98.6 | 94.4 | 94.6 | 89.3 |
| 494372 | 94.1 | 89.3 | 98.9 | 97.5 | 97.2 | 93.6 |
| 693401 | 93.6 | 89.9 | 96.7 | 92.0 | 94.6 | 90.2 |
| 681251 | 95.4 | 93.9 | 99.1 | 98.2 | 97.8 | 96.1 |
| 681257 | 93.4 | 90.5 | 97.6 | 93.7 | 95.6 | 92.7 |

Example 97

Modified Oligonucleotides Targeting TTR Comprising a GalNAc₃ Conjugate Group The oligonucleotides shown in Table 108 comprising a GalNAc conjugate were designed to target TTR.

TABLE 108

Modified oligonucleotides targeting TTR

| ISIS No. | Sequences (5' to 3') | GalNAc₃ Cluster | CM | SEQ ID No. |
|---|---|---|---|---|
| 666941 | GalNAc₃-3$_{a-o'}$A$_{do}$T$_{es}$$^m$C$_{es}$T$_{es}$T$_{es}$G$_{es}$ G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$ T$_{es}$$^m$C$_{es}$$^m$C$_{es}$$^m$C$_e$ | GalNAc₃-3 | A$_d$ | 2273 |
| 666942 | T$_{es}$$^m$C$_{eo}$T$_{eo}$T$_{eo}$G$_{eo}$G$_{ds}$T$_{ds}$T$_{ds}$A$_{ds}$$^m$C$_{ds}$ A$_{ds}$T$_{ds}$G$_{ds}$A$_{ds}$A$_{ds}$A$_{eo}$T$_{eo}$$^m$C$_{es}$$^m$C$_{es}$$^m$C$_{eo}$ Ad$_{o'}$-GalNAc₃-3$_a$ | GalNAc₃-1 | A$_d$ | 2270 |
| 682876 | GalNAc₃-3$_{a-o'}$T$_{es}$$^m$C$_{es}$T$_{es}$T$_{es}$G$_{es}$G$_{ds}$ T$_{ds}$T$_{ds}$A$_{ds}$$^m$C$_{ds}$A$_{ds}$T$_{ds}$G$_{ds}$A$_{ds}$A$_{ds}$A$_{es}$ T$_{es}$$^m$C$_{es}$$^m$C$_{es}$$^m$C$_e$ | GalNAc₃-3 | PO | 2269 |
| 682877 | GalNAc₃-7$_{a-o'}$T$_{es}$$^m$C$_{es}$T$_{es}$T$_{es}$G$_{es}$G$_{ds}$ T$_{ds}$T$_{ds}$A$_{ds}$$^m$C$_{ds}$A$_{ds}$T$_{ds}$G$_{ds}$A$_{ds}$A$_{ds}$A$_{es}$ T$_{es}$$^m$C$_{es}$$^m$C$_{es}$$^m$C$_e$ | GalNAc₃-7 | PO | 2269 |
| 682878 | GalNAc₃-10$_{a-o'}$T$_{es}$$^m$C$_{es}$T$_{es}$T$_{es}$G$_{es}$ G$_{ds}$T$_{ds}$T$_{ds}$A$_{ds}$$^m$C$_{ds}$A$_{ds}$T$_{ds}$G$_{ds}$A$_{ds}$A$_{ds}$ A$_{es}$T$_{es}$$^m$C$_{es}$$^m$C$_{es}$$^m$C$_e$ | GalNAc₃-10 | PO | 2269 |
| 682879 | GalNAc₃-13$_{a-o'}$T$_{es}$$^m$C$_{es}$T$_{es}$T$_{es}$G$_{es}$ G$_{ds}$T$_{ds}$T$_{ds}$A$_{ds}$$^m$C$_{ds}$A$_{ds}$T$_{ds}$G$_{ds}$A$_{ds}$A$_{ds}$ A$_{es}$T$_{es}$$^m$C$_{es}$$^m$C$_{es}$$^m$C$_e$ | GalNAc₃-13 | PO | 2269 |
| 682880 | GalNAc₃-7$_{a-o'}$T$_{es}$$^m$C$_{es}$T$_{es}$T$_{es}$G$_{es}$ G$_{ds}$T$_{ds}$T$_{ds}$A$_{ds}$$^m$C$_{ds}$A$_{ds}$T$_{ds}$G$_{ds}$A$_{ds}$A$_{ds}$ A$_{es}$T$_{es}$$^m$C$_{es}$$^m$C$_{es}$$^m$C$_e$ | GalNAc₃-7 | A$_d$ | 2273 |
| 682881 | GalNAc₃-10$_{a-o'}$T$_{es}$$^m$C$_{es}$T$_{es}$T$_{es}$G$_{es}$ G$_{ds}$T$_{ds}$T$_{ds}$A$_{ds}$$^m$C$_{ds}$A$_{ds}$T$_{ds}$G$_{ds}$A$_{ds}$A$_{ds}$ A$_{es}$T$_{es}$$^m$C$_{es}$$^m$C$_{es}$$^m$C$_e$ | GalNAc₃-10 | A$_d$ | 2273 |
| 682882 | GalNAc₃-13$_{a-o'}$T$_{es}$$^m$C$_{es}$T$_{es}$T$_{es}$G$_{es}$ G$_{ds}$T$_{ds}$T$_{ds}$A$_{ds}$$^m$C$_{ds}$A$_{ds}$T$_{ds}$G$_{ds}$A$_{ds}$A$_{ds}$ A$_{es}$T$_{es}$$^m$C$_{es}$$^m$C$_{es}$$^m$C$_e$ | GalNAc₃-13 | A$_d$ | 2273 |
| 684056 | T$_{es}$$^m$C$_{es}$T$_{es}$T$_{es}$G$_{es}$G$_{ds}$T$_{ds}$T$_{ds}$A$_{ds}$$^m$C$_{ds}$ A$_{ds}$T$_{ds}$G$_{ds}$A$_{ds}$A$_{ds}$A$_{es}$T$_{es}$$^m$C$_{es}$$^m$C$_{es}$$^m$C$_{eo}$ Ad$_{o'}$-GalNAc₃-19$_a$ | GalNAc₃-19 | A$_d$ | 2270 |

The legend for Table 108 can be found in Example 74. The structure of GalNAc₃-1 was shown in Example 9. The structure of GalNAc₃-3$_a$ was shown in Example 39. The structure of GalNAc₃-7$_a$ was shown in Example 48. The structure of GalNAc₃-10$_a$ was shown in Example 46. The structure of GalNAc₃-13$_a$ was shown in Example 62. The structure of GalNAc₃-19$_a$ was shown in Example 70.

Example 98

Evaluation of Pro-inflammatory Effects of Oligonucleotides Comprising a GalNAc Conjugate in hPMBC Assay The oligonucleotides listed in Table 109 and were tested for pro-inflammatory effects in an hPMBC assay as described in Examples 23 and 24. (See Tables 30, 83, 95, and 108 for descriptions of the oligonucleotides.) ISIS 353512 is a high responder used as a positive control, and the other oligonucleotides are described in Tables 83, 95, and 108. The results shown in Table 109 were obtained using blood from one volunteer donor. The results show that the oligonucleotides comprising mixed PO/PS internucleoside linkages produced significantly lower pro-inflammatory responses compared to the same oligonucleotides having full PS linkages. Furthermore, the GalNAc conjugate group did not have a significant effect in this assay.

TABLE 109

| ISIS No. | E$_{max}$/EC$_{50}$ | GalNAc₃ cluster | Linkages | CM |
|---|---|---|---|---|
| 353512 | 3630 | n/a | PS | n/a |
| 420915 | 802 | n/a | PS | n/a |
| 682881 | 1311 | GalNAc₃-10 | PS | A$_d$ |
| 682888 | 0.26 | GalNAc₃-10 | PO/PS | A$_d$ |
| 684057 | 1.03 | GalNAc₃-19 | PO/PS | A$_d$ |

Example 99

Binding Affinities of Oligonucleotides Comprising a GalNAc Conjugate for the Asialoglycoprotein Receptor The binding affinities of the oligonucleotides listed in Table 110 (see Table 76 for descriptions of the oligonucleotides) for the asialoglycoprotein receptor were tested in a competitive receptor binding assay. The competitor ligand, α1-acid glycoprotein (AGP), was incubated in 50 mM sodium acetate buffer (pH 5) with 1 U neuraminidase-agarose for 16 hours at 37° C., and >90% desialylation was confirmed by either sialic acid assay or size exclusion chromatography (SEC). Iodine monochloride was used to iodinate the AGP according to the procedure by Atsma et al. (see J Lipid Res. 1991 January; 32(1):173-81.) In this method, desialylated α1-acid glycoprotein (de-AGP) was added to 10 mM iodine chloride, Na$^{125}$I, and 1 M glycine in 0.25 M NaOH. After incubation for 10 minutes at room temperature, $^{125}$I-labeled de-AGP was separated from free $^{125}$I by concentrating the mixture twice utilizing a 3 KDM-WCO spin column. The protein was tested for labeling efficiency and purity on a HPLC system equipped with an Agilent SEC-3 column (7.8×300 mm) and a β-RAM counter. Competition experiments utilizing $^{125}$I-labeled de-AGP and various GalNAc-cluster containing ASOs were performed as follows. Human HepG2 cells (10⁶ cells/ml) were plated on 6-well plates in 2 ml of appropriate growth media. MEM media supplemented with 10% fetal bovine serum (FBS), 2 mM L-Glutamine and 10 mM HEPES was used. Cells were incubated 16-20 hours @ 37° C. with 5% and 10% CO$_2$ respectively. Cells were washed with media without FBS prior to the experiment. Cells were incubated for 30 min @37° C. with 1 ml competition mix containing appropriate growth media with 2% FBS, 10$^{-8}$ M $^{125}$I-labeled de-AGP and GalNAc-cluster containing ASOs at concentrations ranging from 10$^{-11}$ to 10$^{-5}$ M. Non-specific binding was determined in the presence of 10$^{-2}$ M GalNAc sugar. Cells were washed twice with media without FBS to remove unbound $^{125}$I-labeled de-AGP and competitor GalNAc ASO. Cells were lysed using Qiagen's RLT buffer containing 1% β-mercaptoethanol. Lysates were transferred to round bottom assay tubes after a brief 10 min freeze/thaw cycle and assayed on a γ-counter. Non-specific binding was subtracted before dividing $^{125}$I protein counts by the value of the lowest GalNAc-ASO concentration counts. The inhibition curves were fitted according to a single site competition binding equation using a nonlinear regression algorithm to calculate the binding affinities ($K_D$'s).

The results in Table 110 were obtained from experiments performed on five different days. Results for oligonucleotides marked with superscript "a" are the average of experiments run on two different days. The results show that the oligonucleotides comprising a GalNAc conjugate group on the 5'-end bound the asialoglycoprotein receptor on human HepG2 cells with 1.5 to 16-fold greater affinity than the oligonucleotides comprising a GalNAc conjugate group on the 3'-end.

TABLE 110

Asialoglycoprotein receptor binding assay results

| ISIS No. | GalNAc conjugate | Oligonucleotide end to which GalNAc conjugate is attached | $K_D$ (nM) |
|---|---|---|---|
| 661161[a] | GalNAc$_3$-3 | 5' | 3.7 |
| 666881[a] | GalNAc$_3$-10 | 5' | 7.6 |
| 666981 | GalNAc$_3$-7 | 5' | 6.0 |
| 670061 | GalNAc$_3$-13 | 5' | 7.4 |
| 655861[a] | GalNAc$_3$-1 | 3' | 11.6 |
| 677841[a] | GalNAc$_3$-19 | 3' | 60.8 |

Example 100

Antisense Inhibition In Vivo by Oligonucleotides Comprising a GalNAc Conjugate Group Targeting Apo(a) In Vivo The oligonucleotides listed in Table 111a below were tested in a single dose study for duration of action in mice.

TABLE 111a

Modified ASOs targeting APO(a)

| ISIS No. | Sequences (5' to 3') | GalNAc$_3$ Cluster | CM | SEQ ID No. |
|---|---|---|---|---|
| 681251 | GalNAc$_3$-7$_{a-o}$.T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_e$ | GalNAc$_3$-7a | PO | 2281 |
| 681257 | GalNAc$_3$-7$_{a-o}$.T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_e$ | GalNAc$_3$-7a | PO | 2281 |

The structure of GalNAc$_3$-7$_a$ was shown in Example 48.
Treatment

Female transgenic mice that express human Apo(a) were each injected subcutaneously once per week, for a total of 6 doses, with an oligonucleotide and dosage listed in Table 111b or with PBS. Each treatment group consisted of 3 animals. Blood was drawn the day before dosing to determine baseline levels of Apo(a) protein in plasma and at 72 hours, 1 week, and 2 weeks following the first dose. Additional blood draws will occur at 3 weeks, 4 weeks, 5 weeks, and 6 weeks following the first dose. Plasma Apo(a) protein levels were measured using an ELISA. The results in Table 111b are presented as the average percent of plasma Apo(a) protein levels for each treatment group, normalized to baseline levels (% BL), The results show that the oligonucleotides comprising a GalNAc conjugate group exhibited potent reduction in Apo(a) expression. This potent effect was observed for the oligonucleotide that comprises full PS internucleoside linkages and the oligonucleotide that comprises mixed PO and PS linkages.

TABLE 111b

Apo(a) plasma protein levels

| ISIS No. | Dosage (mg/kg) | Apo(a) at 72 hours (% BL) | Apo(a) at 1 week (% BL) | Apo(a) at 3 weeks (% BL) |
|---|---|---|---|---|
| PBS | n/a | 116 | 104 | 107 |
| 681251 | 0.3 | 97 | 108 | 93 |
|  | 1.0 | 85 | 77 | 57 |
|  | 3.0 | 54 | 49 | 11 |
|  | 10.0 | 23 | 15 | 4 |
| 681257 | 0.3 | 114 | 138 | 104 |
|  | 1.0 | 91 | 98 | 54 |
|  | 3.0 | 69 | 40 | 6 |
|  | 10.0 | 30 | 21 | 4 |

Example 101

Antisense Inhibition by Oligonucleotides Comprising a GalNAc Cluster Linked Via a Stable Moiety The oligonucleotides listed in Table 112 were tested for inhibition of mouse APOC-III expression in vivo. C57Bl/6 mice were each injected subcutaneously once with an oligonucleotide listed in Table 112 or with PBS. Each treatment group consisted of 4 animals. Each mouse treated with ISIS 440670 received a dose of 2, 6, 20, or 60 mg/kg. Each mouse treated with ISIS 680772 or 696847 received 0.6, 2, 6, or 20 mg/kg. The GalNAc conjugate group of ISIS 696847 is linked via a stable moiety, a phosphorothioate linkage instead of a readily cleavable phosphodiester containing linkage. The animals were sacrificed 72 hours after the dose. Liver APOC-III mRNA levels were measured using real-time PCR. APOC-III mRNA levels were normalized to cyclophilin mRNA levels according to standard protocols. The results are presented in Table 112 as the average percent of APOC-III mRNA levels for each treatment group relative to the saline control group. The results show that the oligonucleotides comprising a GalNAc conjugate group were significantly more potent than the oligonucleotide lacking a conjugate group. Furthermore, the oligonucleotide comprising a GalNAc conjugate group linked to the oligonucleotide via a cleavable moiety (ISIS 680772) was even more potent than the oligonucleotide comprising a GalNAc conjugate group linked to the oligonucleotide via a stable moiety (ISIS 696847).

TABLE 112

Modified oligonucleotides targeting mouse APOC-III

| ISIS No. | Sequences (5' to 3') | CM | Dosage (mg/kg) | APOC-III mRNA (% PBS) | SEQ ID No. |
|---|---|---|---|---|---|
| 440670 | $^mC_{es}A_{es}G_{es}{}^mC_{es}T_{es}T_{ds}T_{ds}A_{ds}T_{ds}T_{ds}A_{ds}G_{ds}G_{ds}G_{ds}A_{ds}{}^m$ $C_{es}A_{es}G_{es}{}^mC_{es}A_e$ | n/a | 2 | 92 | 2275 |
|  |  |  | 6 | 86 |  |
|  |  |  | 20 | 59 |  |
|  |  |  | 60 | 37 |  |
| 680772 | GalNAc$_3$-7$_{a-o}$,$^mC_{es}A_{es}G_{es}{}^mC_{es}T_{es}T_{ds}T_{ds}A_{ds}T_{ds}T_{ds}$ $A_{ds}G_{ds}G_{ds}G_{ds}A_{ds}{}^mC_{es}A_{es}G_{es}{}^mC_{es}A_e$ | PO | 0.6 | 79 | 2275 |
|  |  |  | 2 | 58 |  |
|  |  |  | 6 | 31 |  |
|  |  |  | 20 | 13 |  |
| 696847 | GalNAc$_3$-7$_{a-o}$,$^mC_{es}A_{es}G_{es}{}^mC_{es}T_{es}T_{ds}T_{ds}A_{ds}T_{ds}T_{ds}$ $A_{ds}G_{ds}G_{ds}G_{ds}A_{ds}{}^mC_{es}A_{es}G_{es}{}^mC_{es}A_e$ | n/a (PS) | 0.6 | 83 | 2275 |
|  |  |  | 2 | 73 |  |
|  |  |  | 6 | 40 |  |
|  |  |  | 20 | 28 |  |

The structure of GalNAc$_3$-7$_a$ was shown in Example 48.

Example 102

Distribution in Liver of Antisense Oligonucleotides Comprising a GalNAc Conjugate The liver distribution of ISIS 353382 (see Table 36) that does not comprise a GalNAc conjugate and ISIS 655861 (see Table 36) that does comprise a GalNAc conjugate was evaluated. Male balb/c mice were subcutaneously injected once with ISIS 353382 or 655861 at a dosage listed in Table 113. Each treatment group consisted of 3 animals except for the 18 mg/kg group for ISIS 655861, which consisted of 2 animals. The animals were sacrificed 48 hours following the dose to determine the liver distribution of the oligonucleotides. In order to measure the number of antisense oligonucleotide molecules per cell, a Ruthenium (II) tris-bipyridine tag (MSD TAG, Meso Scale Discovery) was conjugated to an oligonucleotide probe used to detect the antisense oligonucleotides. The results presented in Table 113 are the average concentrations of oligonucleotide for each treatment group in units of millions of oligonucleotide molecules per cell. The results show that at equivalent doses, the oligonucleotide comprising a GalNAc conjugate was present at higher concentrations in the total liver and in hepatocytes than the oligonucleotide that does not comprise a GalNAc conjugate. Furthermore, the oligonucleotide comprising a GalNAc conjugate was present at lower concentrations in non-parenchymal liver cells than the oligonucleotide that does not comprise a GalNAc conjugate. And while the concentrations of ISIS 655861 in hepatocytes and non-parenchymal liver cells were similar per cell, the liver is approximately 80% hepatocytes by volume. Thus, the majority of the ISIS 655861 oligonucleotide that was present in the liver was found in hepatocytes, whereas the majority of the ISIS 353382 oligonucleotide that was present in the liver was found in non-parenchymal liver cells.

TABLE 113

| ISIS No. | Dosage (mg/kg) | Concentration in whole liver (molecules*10^6 per cell) | Concentration in hepatocytes (molecules*10^6 per cell) | Concentration in non-parenchymal liver cells (molecules*10^6 per cell) |
|---|---|---|---|---|
| 353382 | 3 | 9.7 | 1.2 | 37.2 |
|  | 10 | 17.3 | 4.5 | 34.0 |
|  | 20 | 23.6 | 6.6 | 65.6 |
|  | 30 | 29.1 | 11.7 | 80.0 |
|  | 60 | 73.4 | 14.8 | 98.0 |
|  | 90 | 89.6 | 18.5 | 119.9 |
| 655861 | 0.5 | 2.6 | 2.9 | 3.2 |
|  | 1 | 6.2 | 7.0 | 8.8 |
|  | 3 | 19.1 | 25.1 | 28.5 |
|  | 6 | 44.1 | 48.7 | 55.0 |
|  | 18 | 76.6 | 82.3 | 77.1 |

Example 103

Duration of Action In Vivo of Oligonucleotides Targeting APOC-III Comprising a GalNAc$_3$ Conjugate The oligonucleotides listed in Table 114 below were tested in a single dose study for duration of action in mice.

TABLE 114

Modified ASOs targeting APOC-III

| ISIS No. | Sequences (5' to 3') | GalNAc$_3$ Cluster | CM | SEQ ID No. |
|---|---|---|---|---|
| 304801 | $A_{es}G_{es}{}^mC_{es}T_{es}T_{es}{}^mC_{ds}T_{ds}T_{ds}G_{ds}T_{ds}{}^m$ $C_{ds}{}^mC_{ds}A_{ds}G_{ds}{}^mC_{ds}T_{es}T_{es}T_{es}A_{es}T_e$ | n/a | n/a | 2248 |
| 663084 | GalNAc$_3$-3$_{a-o}$,$A_{es}G_{eo}{}^mC_{eo}T_{eo}T_{eo}{}^m$ $C_{ds}T_{ds}T_{ds}G_{ds}T_{ds}{}^mC_{ds}{}^mC_{ds}A_{ds}G_{ds}{}^mC_{ds}$ $T_{eo}T_{eo}T_{es}A_{es}T_e$ | GalNAc$_3$-3a | Ad | 2264 |
| 679241 | $A_{es}G_{eo}{}^mC_{eo}T_{eo}T_{eo}{}^mC_{ds}T_{ds}T_{ds}G_{ds}T_{ds}{}^m$ $C_{ds}{}^mC_{ds}A_{ds}G_{ds}{}^mC_{ds}T_{eo}T_{eo}T_{es}A_{es}T_{eo}$ $A_{do'}$-GalNAc$_3$-19$_a$ | GalNAc$_3$-19a | Ad | 2249 |

The structure of GalNAc$_3$-3$_a$ was shown in Example 39, and GalNAc$_3$-19$_a$ was shown in Example 70.

Treatment

Female transgenic mice that express human APOC-III were each injected subcutaneously once with an oligonucleotide listed in Table 114 or with PBS. Each treatment group consisted of 3 animals. Blood was drawn before dosing to determine baseline and at 3, 7, 14, 21, 28, 35, and 42 days following the dose. Plasma triglyceride and APOC-III protein levels were measured as described in Example 20. The results in Table 115 are presented as the average percent of plasma triglyceride and APOC-III levels for each treatment group, normalized to baseline levels. A comparison of the results in Table 71 of example 79 with the results in Table 115 below show that oligonucleotides comprising a mixture of phosphodiester and phosphorothioate internucleoside linkages exhibited increased duration of action than equivalent oligonucleotides comprising only phosphorothioate internucleoside linkages.

TABLE 115

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
| PBS | n/a | 3 | 96 | 101 | n/a | n/a |
|  |  | 7 | 88 | 98 |  |  |
|  |  | 14 | 91 | 103 |  |  |
|  |  | 21 | 69 | 92 |  |  |
|  |  | 28 | 83 | 81 |  |  |
|  |  | 35 | 65 | 86 |  |  |
|  |  | 42 | 72 | 88 |  |  |

TABLE 115-continued

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
| 304801 | 30 | 3 | 42 | 46 | n/a | n/a |
|  |  | 7 | 42 | 51 |  |  |
|  |  | 14 | 59 | 69 |  |  |
|  |  | 21 | 67 | 81 |  |  |
|  |  | 28 | 79 | 76 |  |  |
|  |  | 35 | 72 | 95 |  |  |
|  |  | 42 | 82 | 92 |  |  |
| 663084 | 10 | 3 | 35 | 28 | GalNAc$_3$-3a | A$_d$ |
|  |  | 7 | 23 | 24 |  |  |
|  |  | 14 | 23 | 26 |  |  |
|  |  | 21 | 23 | 29 |  |  |
|  |  | 28 | 30 | 22 |  |  |
|  |  | 35 | 32 | 36 |  |  |
|  |  | 42 | 37 | 47 |  |  |
| 679241 | 10 | 3 | 38 | 30 | GalNAc$_3$-19a | A$_d$ |
|  |  | 7 | 31 | 28 |  |  |
|  |  | 14 | 30 | 22 |  |  |
|  |  | 21 | 36 | 34 |  |  |
|  |  | 28 | 48 | 34 |  |  |
|  |  | 35 | 50 | 45 |  |  |
|  |  | 42 | 72 | 64 |  |  |

Example 104

Synthesis of Oligonucleotides Comprising a 5'-GalNAc$_2$ Conjugate

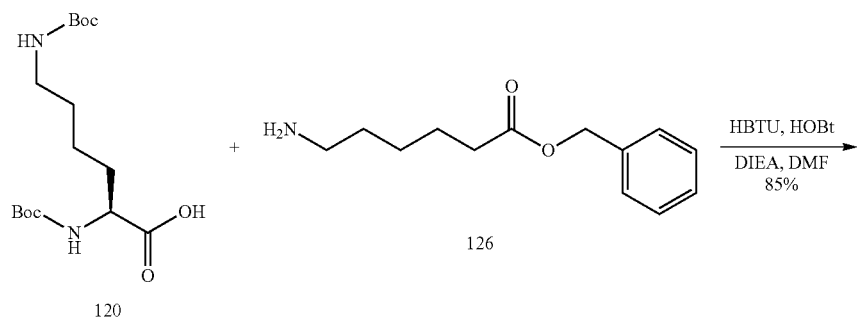

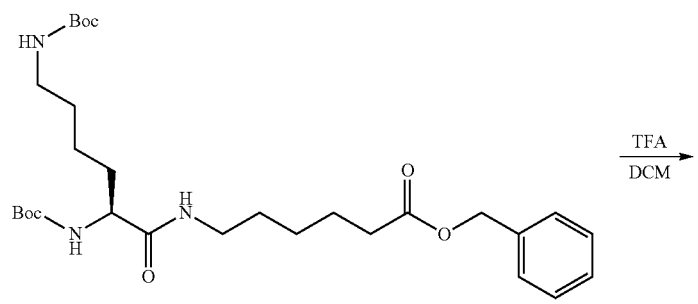

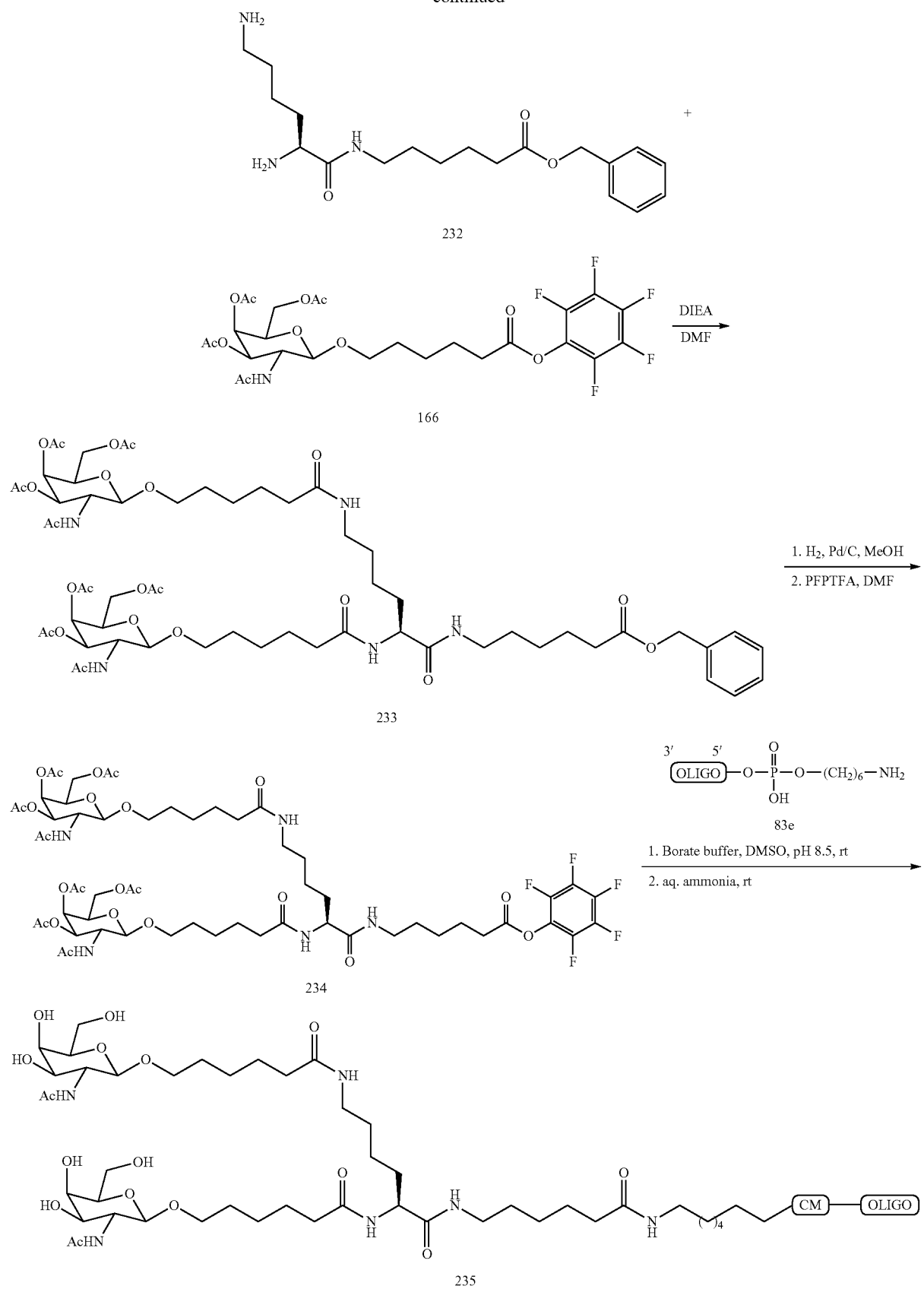

Compound 120 is commercially available, and the synthesis of compound 126 is described in Example 49. Compound 120 (1 g, 2.89 mmol), HBTU (0.39 g, 2.89 mmol), and HOBt (1.64 g, 4.33 mmol) were dissolved in DMF (10 mL. and N,N-diisopropylethylamine (1.75 mL, 10.1 mmol) were added. After about 5 min, aminohexanoic acid benzyl ester (1.36 g, 3.46 mmol) was added to the reaction. After 3h, the reaction mixture was poured into 100 mL of 1 M NaHSO4 and extracted with 2×50 mL ethyl acetate. Organic layers were combined and washed with 3×40 mL sat NaHCO$_3$ and 2× brine, dried with Na$_2$SO$_4$, filtered and concentrated. The product was purified by silica gel column chromatography (DCM:EA:Hex, 1:1:1) to yield compound 231. LCMS and NMR were consistent with the structure. Compounds 231 (1.34 g, 2.438 mmol) was dissolved in dichloromethane (10 mL) and trifluoracetic acid (10 mL) was added. After stirring at room temperature for 2h, the reaction mixture was concentrated under reduced pressure and co-evaporated with toluene (3×10 mL). The residue was dried under reduced pressure to yield compound 232 as the trifluoracetate salt. The synthesis of compound 166 is described in Example 54. Compound 166 (3.39 g, 5.40 mmol) was dissolved in DMF (3 mL). A solution of compound 232 (1.3 g, 2.25 mmol) was dissolved in DMF (3 mL) and N,N-diisopropylethylamine (1.55 mL) was added. The reaction was stirred at room temperature for 30 minutes, then poured into water (80 mL) and the aqueous layer was extracted with EtOAc (2×100 mL). The organic phase was separated and washed with sat. aqueous NaHCO$_3$ (3×80 mL), 1 M NaHSO$_4$ (3×80 mL) and brine (2×80 mL), then dried (Na$_2$SO$_4$), filtered, and concentrated. The residue was purified by silica gel column chromatography to yield compound 233. LCMS and NMR were consistent with the structure. Compound 233 (0.59 g, 0.48 mmol) was dissolved in methanol (2.2 mL) and ethyl acetate (2.2 mL). Palladium on carbon (10 wt % Pd/C, wet, 0.07 g) was added, and the reaction mixture was stirred under hydrogen atmosphere for 3 h. The reaction mixture was filtered through a pad of Celite and concentrated to yield the carboxylic acid. The carboxylic acid (1.32 g, 1.15 mmol, cluster free acid) was dissolved in DMF (3.2 mL). To this N,N-diisopropylethylamine (0.3 mL, 1.73 mmol) and PFPTFA (0.30 mL, 1.73 mmol) were added. After 30 min stirring at room temperature the reaction mixture was poured into water (40 mL) and extracted with EtOAc (2×50 mL). A standard work-up was completed as described above to yield compound 234. LCMS and NMR were consistent with the structure. Oligonucleotide 235 was prepared using the general procedure described in Example 46. The GalNAc$_2$ cluster portion (GalNAc$_2$-24$_a$) of the conjugate group GalNAc$_2$-24 can be combined with any cleavable moiety present on the oligonucleotide to provide a variety of conjugate groups. The structure of GalNAc$_2$-24 (GalNAc$_2$-24$_a$-CM) is shown below:

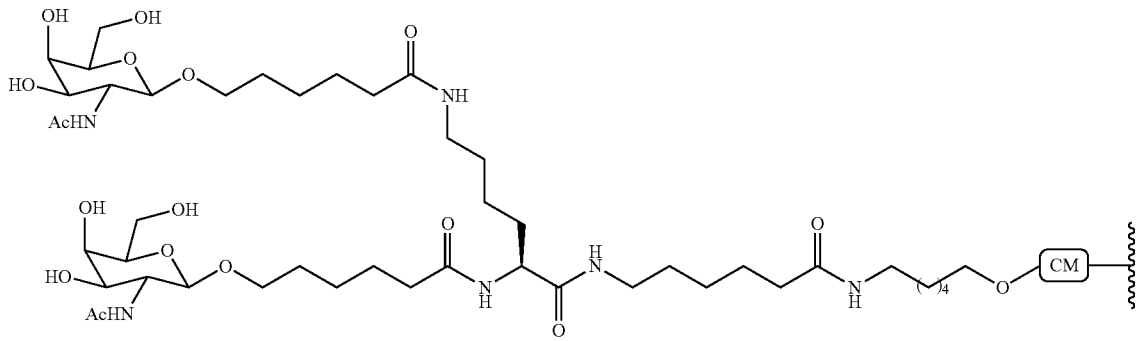

Example 105

Synthesis of Oligonucleotides Comprising a GalNAc$_1$-25 Conjugate

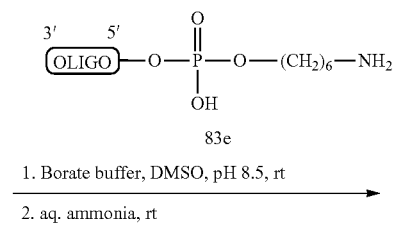

1. Borate buffer, DMSO, pH 8.5, rt
2. aq. ammonia, rt

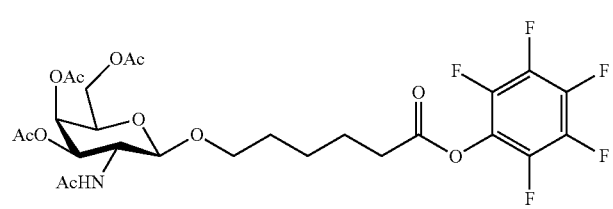

166

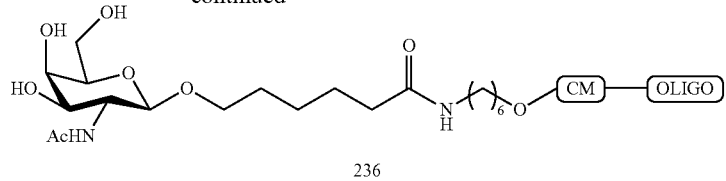
236
The synthesis of compound 166 is described in Example 54. Oligonucleotide 236 was prepared using the general procedure described in Example 46.
Alternatively, oligonucleotide 236 was synthesized using the scheme shown below, and compound 238 was used to form the oligonucleotide 236 using procedures described in Example 10.
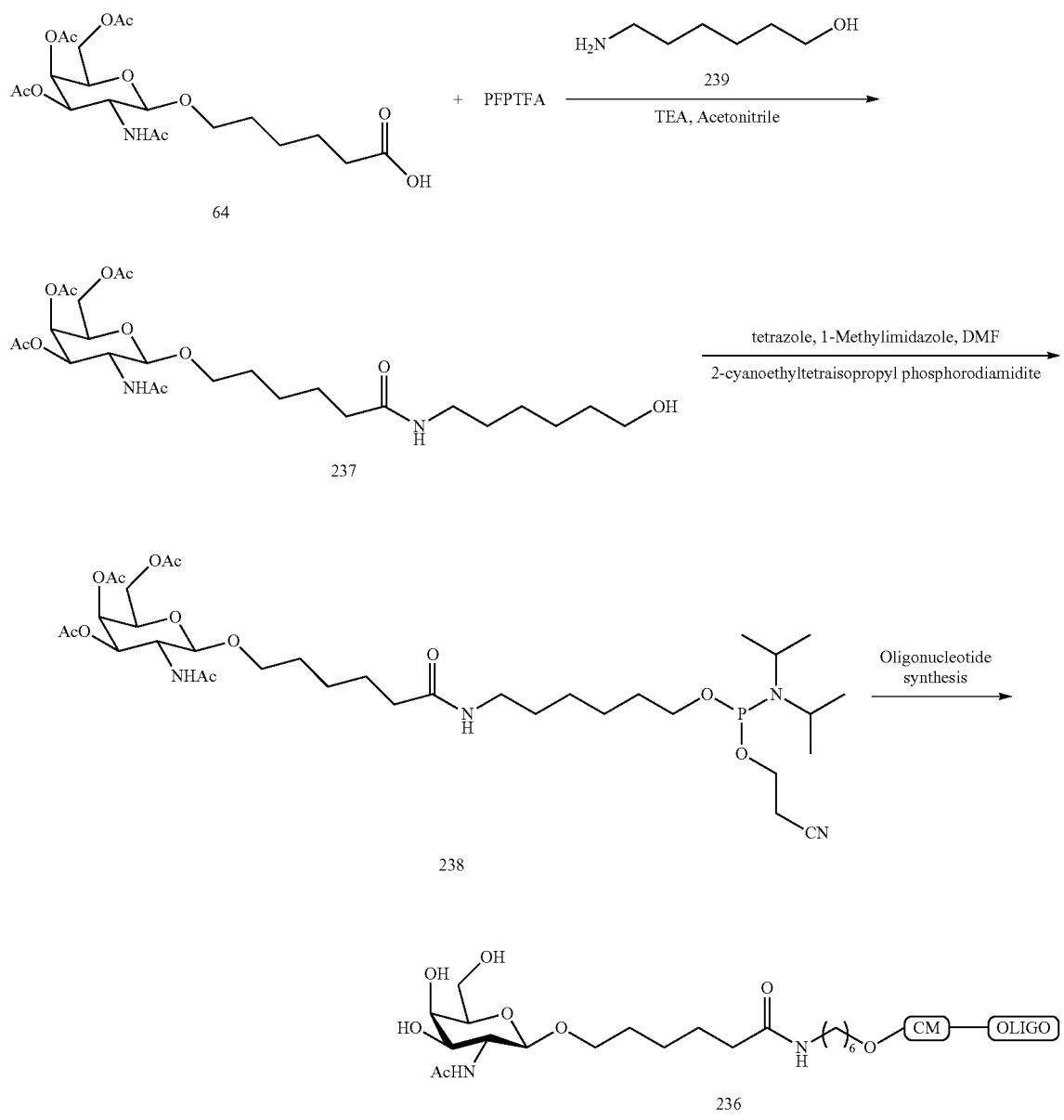

The GalNAc$_1$ cluster portion (GalNAc$_1$-25$_a$) of the conjugate group GalNAc$_1$-25 can be combined with any cleavable moiety present on the oligonucleotide to provide a variety of conjugate groups. The structure of GalNAc$_1$-25 (GalNAc$_1$-25$_a$-CM) is shown below:

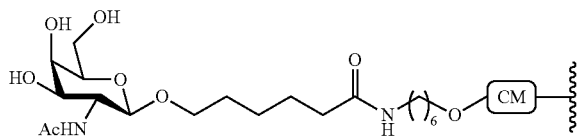

Example 106

Antisense Inhibition In Vivo by Oligonucleotides Targeting SRB-1 Comprising a 5'-GalNAc$_2$ or a 5'-GalNAc$_3$ Conjugate Oligonucleotides listed in Tables 116 and 117 were tested in dose-dependent studies for antisense inhibition of SRB-1 in mice.

Treatment

Six to week old, male C57BL/6 mice (Jackson Laboratory, Bar Harbor, Me.) were injected subcutaneously once with 2, 7, or 20 mg/kg of ISIS No. 440762; or with 0.2, 0.6, 2, 6, or 20 mg/kg of ISIS No. 686221, 686222, or 708561; or with saline. Each treatment group consisted of 4 animals. The mice were sacrificed 72 hours following the final administration. Liver SRB-1 mRNA levels were measured using real-time PCR. SRB-1 mRNA levels were normalized to cyclophilin mRNA levels according to standard protocols. The antisense oligonucleotides lowered SRB-1 mRNA levels in a dose-dependent manner, and the ED$_{50}$ results are presented in Tables 116 and 117. Although previous studies showed that trivalent GalNAc-conjugated oligonucleotides were significantly more potent than divalent GalNAc-conjugated oligonucleotides, which were in turn significantly more potent than monovalent GalNAc conjugated oligonucleotides (see, e.g., Khorev et al., *Bioorg. & Med. Chem.*, Vol. 16, 5216-5231 (2008)), treatment with antisense oligonucleotides comprising monovalent, divalent, and trivalent GalNAc clusters lowered SRB-1 mRNA levels with similar potencies as shown in Tables 116 and 117.

TABLE 116

Modified oligonucleotides targeting SRB-1

| ISIS No. | Sequences (5' to 3') | GalNAc Cluster | ED$_{50}$ (mg/kg) | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$Ck | n/a | 4.7 | 2250 |
| 686221 | GalNAc2-24$_{a-o}$,A$_{do}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_3$-24$_a$ | 0.39 | 2254 |
| 686222 | GalNAc$_3$-13$_{a-o}$,A$_{do}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_3$-13$_a$ | 0.41 | 2254 |

See Example 93 for table legend. The structure of GalNAc$_3$-13a was shown in Example 62, and the structure of GalNAc$_2$-24a was shown in Example 104.

TABLE 117

Modified oligonucleotides targeting SRB-1

| ISIS No. | Sequences (5' to 3') | GalNAc Cluster | ED50 (mg/kg) | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | n/a | 5 | 2250 |
| 708561 | GalNAc$_1$-25$_{a-o}$,T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_1$-25$_a$ | 0.4 | 2250 |

See Example 93 for table legend. The structure of GalNAc$_1$-25a was shown in Example 105.

The concentrations of the oligonucleotides in Tables 116 and 117 in liver were also assessed, using procedures described in Example 75. The results shown in Tables 117a and 117b below are the average total antisense oligonucleotide tissues levels for each treatment group, as measured by UV in units of μg oligonucleotide per gram of liver tissue. The results show that the oligonucleotides comprising a GalNAc conjugate group accumulated in the liver at significantly higher levels than the same dose of the oligonucleotide lacking a GalNAc conjugate group. Furthermore, the antisense oligonucleotides comprising one, two, or three GalNAc ligands in their respective conjugate groups all accumulated in the liver at similar levels. This result is surprising in view of the Khorev et al. literature reference cited above and is consistent with the activity data shown in Tables 116 and 117 above.

TABLE 117a

Liver concentrations of oligonucleotides comprising a GalNAc$_2$ or GalNAc$_3$ conjugate group

| ISIS No. | Dosage (mg/kg) | [Antisense oligonucleotide] (μg/g) | GalNAc cluster | CM |
|---|---|---|---|---|
| 440762 | 2 | 2.1 | n/a | n/a |
|  | 7 | 13.1 |  |  |
|  | 20 | 31.1 |  |  |
| 686221 | 0.2 | 0.9 | GalNAc$_2$-24$_a$ | A$_d$ |
|  | 0.6 | 2.7 |  |  |
|  | 2 | 12.0 |  |  |
|  | 6 | 26.5 |  |  |
| 686222 | 0.2 | 0.5 | GalNAc$_3$-13$_a$ | A$_d$ |
|  | 0.6 | 1.6 |  |  |
|  | 2 | 11.6 |  |  |
|  | 6 | 19.8 |  |  |

TABLE 117b

Liver concentrations of oligonucleotides comprising a GalNAc$_1$ conjugate group

| ISIS No. | Dosage (mg/kg) | [Antisense oligonucleotide] (μg/g) | GalNAc cluster | CM |
|---|---|---|---|---|
| 440762 | 2 | 2.3 | n/a | n/a |
|  | 7 | 8.9 |  |  |
|  | 20 | 23.7 |  |  |
| 708561 | 0.2 | 0.4 | GalNAc$_1$-25$_a$ | PO |
|  | 0.6 | 1.1 |  |  |
|  | 2 | 5.9 |  |  |
|  | 6 | 23.7 |  |  |
|  | 20 | 53.9 |  |  |

Example 107

Synthesis of Oligonucleotides Comprising a GalNAc₁-26 or GalNAc₁-27 Conjugate

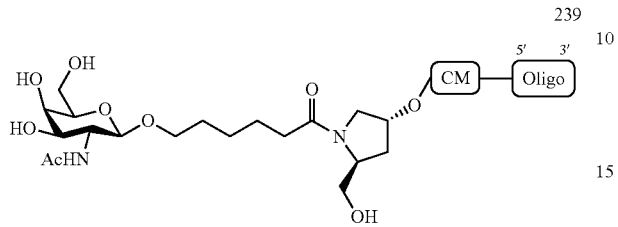

239

Oligonucleotide 239 is synthesized via coupling of compound 47 (see Example 15) to acid 64 (see Example 32) using HBTU and DIEA in DMF. The resulting amide containing compound is phosphitylated, then added to the 5'-end of an oligonucleotide using procedures described in Example 10. The GalNAc₁ cluster portion (GalNAc₁-26$_a$) of the conjugate group GalNAc₁-26 can be combined with any cleavable moiety present on the oligonucleotide to provide a variety of conjugate groups. The structure of GalNAc₁-26 (GalNAc₁-26$_a$-CM) is shown below:

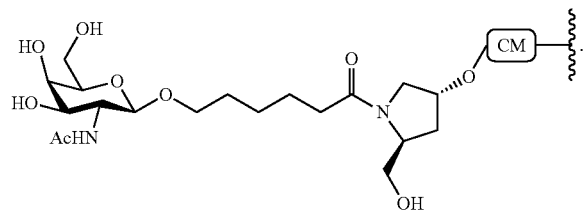

In order to add the GalNAc₁ conjugate group to the 3'-end of an oligonucleotide, the amide formed from the reaction of compounds 47 and 64 is added to a solid support using procedures described in Example 7. The oligonucleotide synthesis is then completed using procedures described in Example 9 in order to form oligonucleotide 240.

240

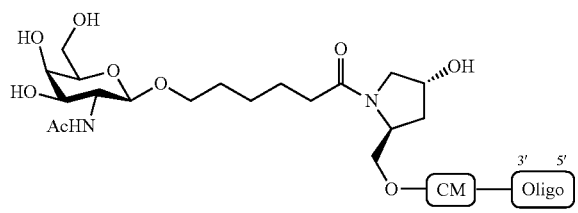

The GalNAc₁ cluster portion (GalNAc₁-27$_a$) of the conjugate group GalNAc₁-27 can be combined with any cleavable moiety present on the oligonucleotide to provide a variety of conjugate groups. The structure of GalNAc₁-27 (GalNAc₁-27$_a$-CM) is shown below:

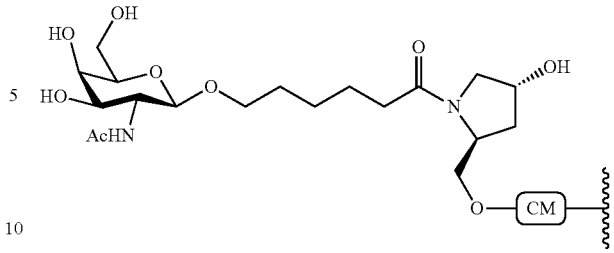

Example 108

Antisense Inhibition In Vivo by Oligonucleotides Comprising a GalNAc Conjugate Group Targeting Apo(a) In Vivo The oligonucleotides listed in Table 118 below were tested in a single dose study in mice.

TABLE 118

Modified ASOs targeting APO(a)

| ISIS No. | Sequences (5' to 3') | GalNAc₃ Cluster | CM | SEQ ID No. |
|---|---|---|---|---|
| 494372 | $T_{es}G_{es}{}^mC_{es}T_{es}{}^mC_{es}{}^mC_{ds}G_{ds}T_{ds}T_{ds}G_{ds}$ $G_{ds}T_{ds}G_{ds}{}^mC_{ds}T_{ds}T_{es}G_{es}T_{es}T_{es}{}^mC_e$ | n/a | n/a | 2281 |
| 681251 | GalNAc₃-7$_{a-o}$, $T_{es}G_{es}{}^mC_{es}T_{es}{}^mC_{es}{}^m$ $C_{ds}G_{ds}T_{ds}T_{ds}G_{ds}G_{ds}T_{ds}G_{ds}{}^mC_{ds}T_{ds}$ $T_{es}G_{es}T_{es}T_{es}{}^mC_e$ | GalNAc₃-7a | PO | 2281 |
| 681255 | GalNAc₃-3$_{a-o}$, $T_{es}G_{eo}{}^mC_{eo}T_{eo}{}^mC_{eo}{}^m$ $C_{ds}G_{ds}T_{ds}T_{ds}G_{ds}G_{ds}T_{ds}G_{ds}{}^mC_{ds}T_{ds}$ $T_{eo}G_{eo}T_{es}T_{es}{}^mC_e$ | GalNAc₃-3a | PO | 2281 |
| 681256 | GalNAc₃-10$_{a-o}$, $T_{es}G_{eo}{}^mC_{eo}T_{eo}{}^m$ $C_{eo}{}^mC_{ds}G_{ds}T_{ds}T_{ds}G_{ds}G_{ds}T_{ds}G_{ds}{}^mC_{ds}$ $T_{ds}T_{eo}G_{eo}T_{es}T_{es}{}^mC_e$ | GalNAc₃-10a | PO | 2281 |
| 681257 | GalNAc₃-7$_{a-o}$, $T_{es}G_{eo}{}^mC_{eo}T_{eo}{}^m$ $C_{eo}{}^mC_{ds}G_{ds}T_{ds}T_{ds}G_{ds}G_{ds}T_{ds}G_{ds}{}^mC_{ds}$ $T_{ds}T_{eo}G_{eo}T_{es}T_{es}{}^mC_e$ | GalNAc₃-7a | PO | 2281 |
| 681258 | GalNAc₃-13$_{a-o}$, $T_{es}G_{eo}{}^mC_{eo}T_{eo}{}^m$ $C_{eo}{}^mC_{ds}G_{ds}T_{ds}T_{ds}G_{ds}G_{ds}T_{ds}G_{ds}{}^mC_{ds}$ $T_{ds}T_{eo}G_{eo}T_{es}T_{es}{}^mC_e$ | GalNAc₃-13a | PO | 2281 |
| 681260 | $T_{es}G_{eo}{}^mC_{eo}T_{eo}{}^mC_{eo}{}^mC_{ds}G_{ds}T_{ds}T_{ds}G_{ds}$ $G_{ds}T_{ds}G_{ds}{}^mC_{ds}T_{ds}T_{eo}G_{eo}T_{es}T_{es}{}^mC_{eo}$ A$_{do}$, -GalNAc₃-19 | GalNAc₃-19a | A$_d$ | 2280 |

The structure of GalNAc₃-7$_a$ was shown in Example 48.

Treatment

Male transgenic mice that express human Apo(a) were each injected subcutaneously once with an oligonucleotide and dosage listed in Table 119 or with PBS. Each treatment group consisted of 4 animals. Blood was drawn the day before dosing to determine baseline levels of Apo(a) protein in plasma and at 1 week following the first dose. Additional blood draws will occur weekly for approximately 8 weeks. Plasma Apo(a) protein levels were measured using an ELISA. The results in Table 119 are presented as the average percent of plasma Apo(a) protein levels for each treatment group, normalized to baseline levels (% BL), The results show that the antisense oligonucleotides reduced Apo(a) protein expression. Furthermore, the oligonucleotides comprising a GalNAc conjugate group exhibited even more potent reduction in Apo(a) expression than the oligonucleotide that does not comprise a conjugate group.

TABLE 119

Apo(a) plasma protein levels

| ISIS No. | Dosage (mg/kg) | Apo(a) at 1 week (% BL) |
|---|---|---|
| PBS | n/a | 143 |
| 494372 | 50 | 58 |
| 681251 | 10 | 15 |
| 681255 | 10 | 14 |
| 681256 | 10 | 17 |
| 681257 | 10 | 24 |
| 681258 | 10 | 22 |
| 681260 | 10 | 26 |

Example 109

Synthesis of Oligonucleotides Comprising a GalNAc$_1$-28 or GalNAc$_1$-29 Conjugate

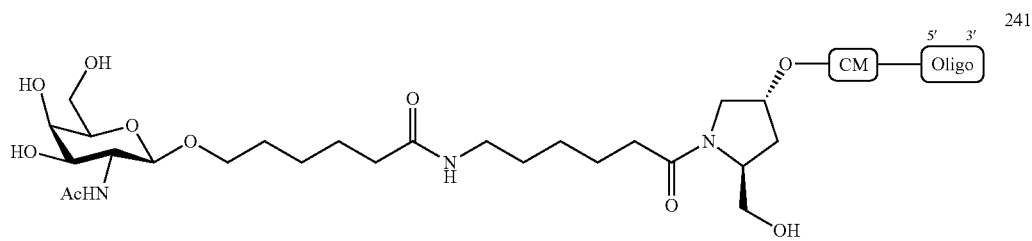

Oligonucleotide 241 is synthesized using procedures similar to those described in Example 71 to form the phosphoramidite intermediate, followed by procedures described in Example 10 to synthesize the oligonucleotide. The GalNAc$_1$ cluster portion (GalNAc$_1$-28$_a$) of the conjugate group GalNAc$_1$-28 can be combined with any cleavable moiety present on the oligonucleotide to provide a variety of conjugate groups. The structure of GalNAc$_1$-28 (GalNAc$_1$-28$_a$-CM) is shown below:

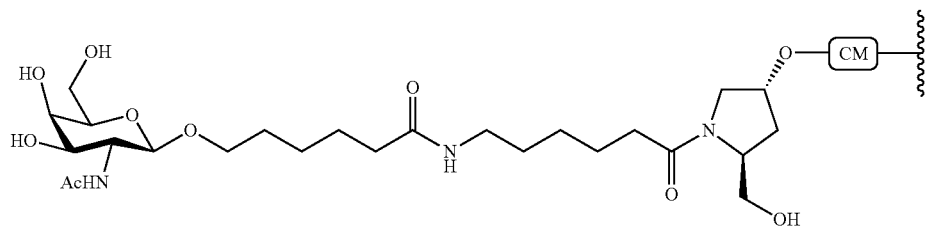

In order to add the GalNAc$_1$ conjugate group to the 3'-end of an oligonucleotide, procedures similar to those described in Example 71 are used to form the hydroxyl intermediate, which is then added to the solid support using procedures described in Example 7. The oligonucleotide synthesis is then completed using procedures described in Example 9 in order to form oligonucleotide 242.

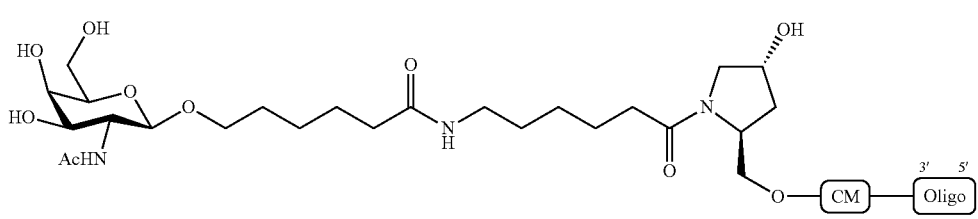
242
The GalNAc₁ cluster portion (GalNAc₁-29$_a$) of the conjugate group GalNAc₁-29 can be combined with any cleavable moiety present on the oligonucleotide to provide a variety of conjugate groups. The structure of GalNAc₁-29 (GalNAc₁-29$_a$-CM) is shown below:
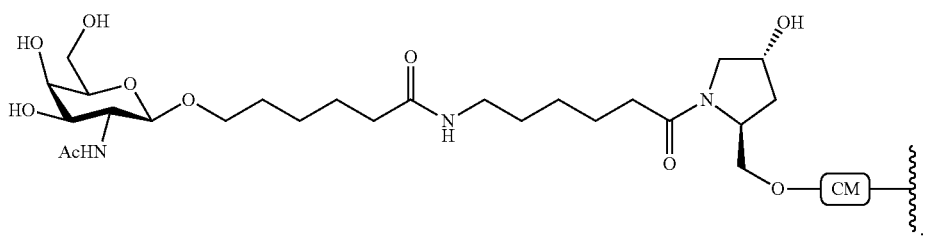
Example 110
Synthesis of Oligonucleotides Comprising a GalNAc₁-30 Conjugate
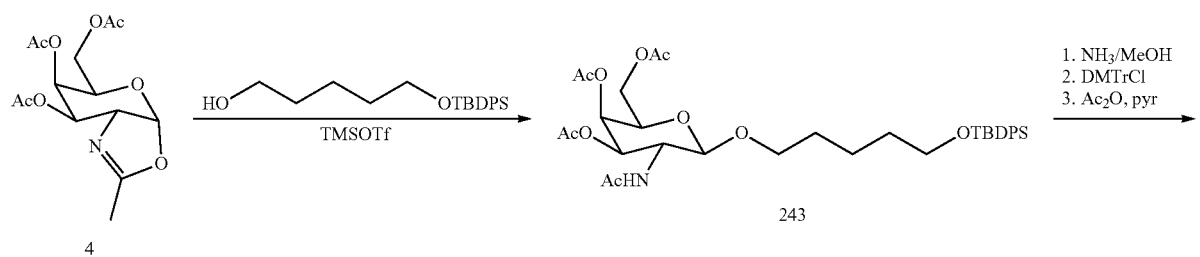
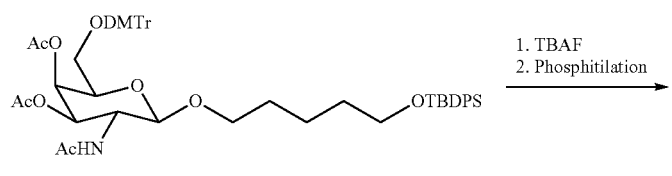
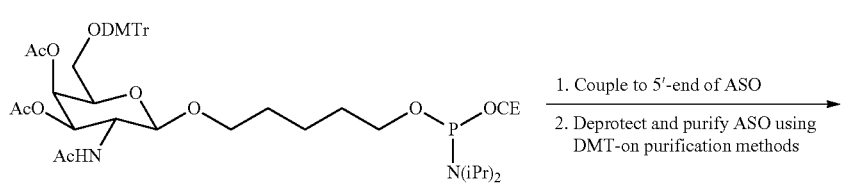

-continued

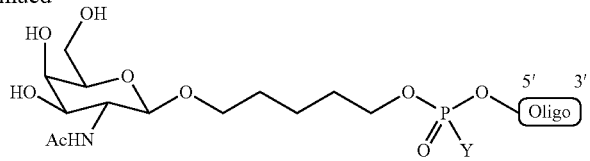

246

Oligonucleotide 246 comprising a GalNAc$_1$-30 conjugate group, wherein Y is selected from O, S, a substituted or unsubstituted C$_1$-C$_{10}$ alkyl, amino, substituted amino, azido, alkenyl or alkynyl, is synthesized as shown above. The GalNAc$_1$ cluster portion (GalNAc$_1$-30$_a$) of the conjugate group GalNAc$_1$-30 can be combined with any cleavable moiety to provide a variety of conjugate groups. In certain embodiments, Y is part of the cleavable moiety. In certain embodiments, Y is part of a stable moiety, and the cleavable moiety is present on the oligonucleotide. The structure of GalNAc$_1$-30$_a$ is shown below:

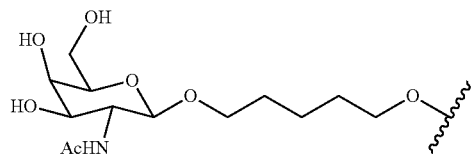 [SMILES: *OCCCCCOC1OC(CO)C(O)C(O)C1NC(C)=O]

Example 111

Synthesis of Oligonucleotides Comprising a GalNAc$_2$-31 or GalNAc$_2$-32 Conjugate

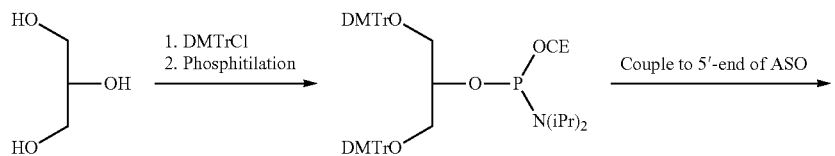

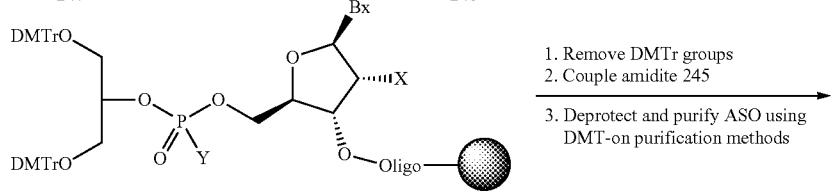

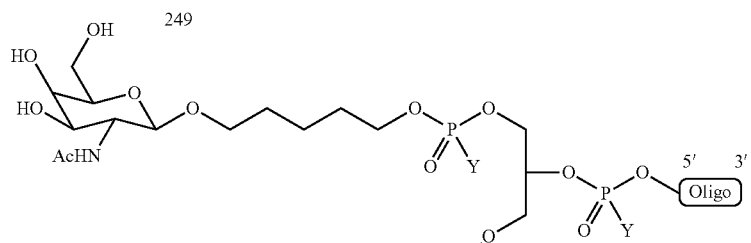

249

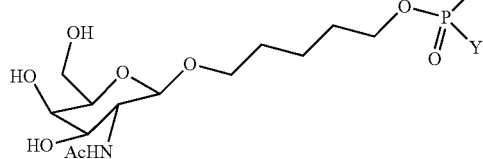

250

Oligonucleotide 250 comprising a GalNAc$_2$-31 conjugate group, wherein Y is selected from O, S, a substituted or unsubstituted C$_1$-C$_{10}$ alkyl, amino, substituted amino, azido, alkenyl or alkynyl, is synthesized as shown above. The GalNAc$_2$ cluster portion (GalNAc$_2$-31$_a$) of the conjugate group GalNAc$_2$-31 can be combined with any cleavable moiety to provide a variety of conjugate groups. In certain embodiments, the Y-containing group directly adjacent to the 5'-end of the oligonucleotide is part of the cleavable moiety. In certain embodiments, the Y-containing group directly adjacent to the 5'-end of the oligonucleotide is part of a stable moiety, and the cleavable moiety is present on the oligonucleotide. The structure of GalNAc$_2$-31$_a$ is shown below:

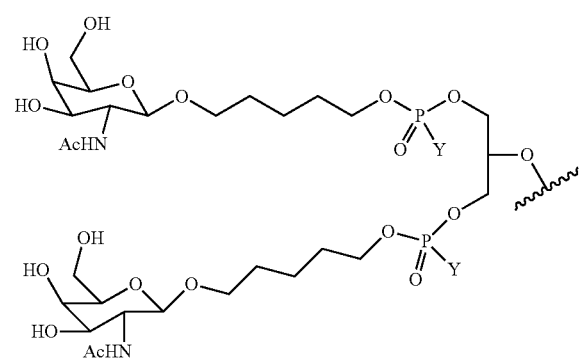

Oligonucleotide 252 comprising a GalNAc$_2$-32 conjugate group, wherein Y is selected from O, S, a substituted or unsubstituted C$_1$-C$_{10}$ alkyl, amino, substituted amino, azido, alkenyl or alkynyl, is synthesized as shown above. The GalNAc$_2$ cluster portion (GalNAc$_2$-32$_a$) of the conjugate group GalNAc$_2$-32 can be combined with any cleavable moiety to provide a variety of conjugate groups. In certain embodiments, the Y-containing group directly adjacent to the 5'-end of the oligonucleotide is part of the cleavable moiety. In certain embodiments, the Y-containing group directly adjacent to the 5'-end of the oligonucleotide is part of a stable moiety, and the cleavable moiety is present on the oligonucleotide. The structure of GalNAc$_2$-32$_a$ is shown below:

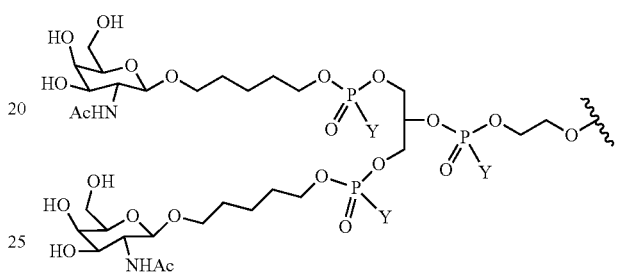

Example 112

Modified Oligonucleotides Comprising a GalNAc$_1$ Conjugate

The synthesis of an oligonucleotide comprising a GalNAc$_2$-32 conjugate is shown below.

The oligonucleotides in Table 120 targeting SRB-1 were synthesized with a GalNAc$_1$ conjugate group in order to

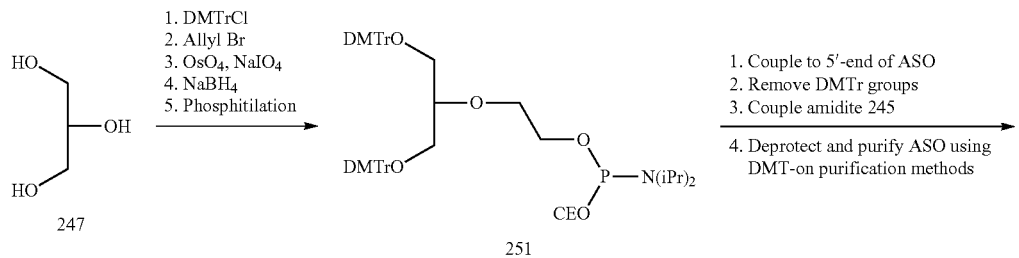

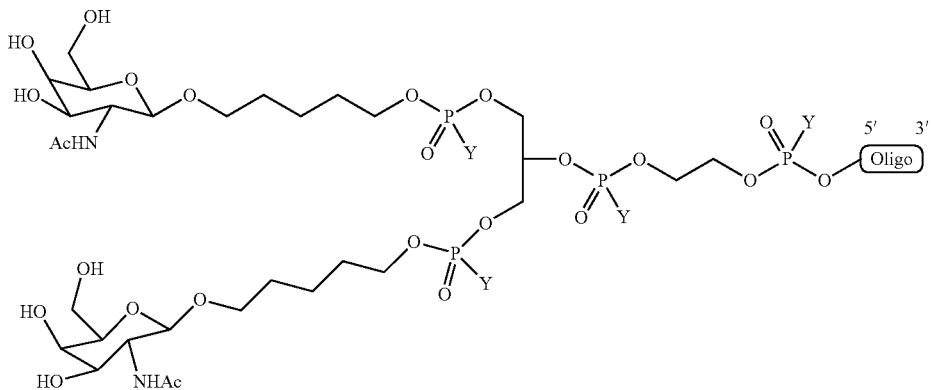

further test the potency of oligonucleotides comprising conjugate groups that contain one GalNAc ligand.

TABLE 120

| ISIS No. | Sequence (5' to 3') | GalNAc cluster CM | SEQ ID NO. |
|---|---|---|---|
| 711461 | GalNAc$_1$-25$_{a-o}$,A$_{do}$G$_{es}$$^m$C$_{es}$T$_{es}$T$_{es}$$^m$ C$_{es}$A$_{ds}$G$_{ds}$T$_{ds}$$^m$C$_{ds}$A$_{ds}$T$_{ds}$G$_{ds}$A$_{ds}$$^m$C$_{ds}$ T$_{ds}$T$_{es}$$^m$C$_{es}$$^m$C$_{es}$T$_e$ | GalNAc$_1$- A$_d$ 25$_a$ | 2258 |
| 711462 | GalNAc$_1$-25$_{a-o}$,G$_{es}$$^m$C$_{es}$T$_{es}$T$_{es}$$^m$C$_{es}$ A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{es}$T$_e$ | GalNAc$_1$- PO 25$_a$ | 2256 |
| 711463 | GalNAc$_1$-25$_{a-o}$,G$_{es}$$^m$C$_{eo}$T$_{eo}$T$_{eo}$$^m$C$_{eo}$ A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{eo}$$^m$C$_{eo}$$^m$C$_{es}$T$_{es}$T$_e$ | GalNAc$_1$- PO 25$_a$ | 2256 |
| 711465 | GalNAc$_1$-26$_{a-o}$,A$_{do}$G$_{es}$$^m$C$_{es}$T$_{es}$T$_{es}$$^m$ C$_{es}$A$_{ds}$G$_{ds}$T$_{ds}$$^m$C$_{ds}$A$_{ds}$T$_{ds}$GdsA$_{ds}$$^m$C$_{ds}$ T$_{ds}$T$_{es}$$^m$C$_{es}$$^m$C$_{es}$T$_e$ | GalNAc$_1$- A$_d$ 26$_a$ | 2258 |
| 711466 | GalNAc$_1$-26$_{a-o}$,G$_{es}$$^m$C$_{es}$T$_{es}$T$_{es}$$^m$C$_{es}$ A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{es}$T$_e$ | GalNAc$_1$- PO 26$_a$ | 2256 |
| 711467 | GalNAc$_1$-26$_{a-o}$,G$_{es}$$^m$C$_{eo}$T$_{eo}$T$_{eo}$$^m$C$_{eo}$ A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{eo}$$^m$C$_{eo}$$^m$C$_{es}$T$_{es}$T$_e$ | GalNAc$_1$- PO 26$_a$ | 2256 |
| 711468 | GalNAc$_1$-28$_{a-o}$,A$_{do}$G$_{es}$$^m$C$_{es}$T$_{es}$T$_{es}$$^m$ C$_{es}$A$_{ds}$G$_{ds}$T$_{ds}$$^m$C$_{ds}$A$_{ds}$T$_{ds}$G$_{ds}$A$_{ds}$$^m$C$_{ds}$ T$_{ds}$T$_{es}$$^m$C$_{es}$$^m$C$_{es}$T$_e$ | GalNAc$_1$- A$_d$ 28$_a$ | 2258 |
| 711469 | GalNAc$_1$-28$_{a-o}$,G$_{es}$$^m$C$_{es}$T$_{es}$T$_{es}$$^m$C$_{es}$ A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{es}$$^m$C$_{es}$$^m$C$_{es}$T$_{es}$T$_e$ | GalNAc$_1$- PO 28$_a$ | 2256 |
| 711470 | GalNAc$_1$-28$_{a-o}$,G$_{es}$$^m$C$_{eo}$T$_{eo}$T$_{eo}$$^m$C$_{eo}$ A$_{ds}$G$_{ds}$T$_{ds}$$^m$C$_{ds}$A$_{ds}$T$_{ds}$G$_{ds}$A$_{ds}$$^m$C$_{ds}$T$_{ds}$ T$_{eo}$$^m$C$_{eo}$$^m$C$_{es}$T$_{es}$T$_e$ | GalNAc$_1$- PO 28$_a$ | 2256 |
| 713844 | G$_{es}$$^m$C$_{es}$T$_{es}$T$_{es}$$^m$C$_{es}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{es}$$^m$C$_{es}$$^m$C$_{es}$T$_{es}$ T$_{eo}$'$_-$GalNAc$_1$-27$_{-o}$' | GalNAc$_1$- PO 27$_a$ | 2256 |
| 713845 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{eo}$$^m$C$_{eo}$$^m$C$_{es}$T$_{es}$ T$_{eo}$'$_-$GalNAc$_1$-27$_{a-o}$' | GalNAc$_1$- PO 27$_a$ | 2256 |
| 713846 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{eo}$$^m$C$_{eo}$$^m$C$_{es}$T$_{es}$T$_{eo}$ A$_{do}$'-GalNAc$_1$-27$_a$ | GalNAc$_1$- A$_d$ 27$_a$ | 2257 |
| 713847 | G$_{es}$$^m$C$_{es}$T$_{es}$T$_{es}$$^m$C$_{es}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{es}$$^m$C$_{es}$$^m$C$_{es}$T$_{es}$ T$_{eo}$'$_-$GalNAc$_1$-29$_{-o}$' | GalNAc$_1$- PO 29$_a$ | 2256 |
| 713848 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{eo}$$^m$C$_{eo}$$^m$C$_{es}$T$_{es}$ T$_{eo}$'$_-$GalNAc$_1$-29$_{-o}$' | GalNAc$_1$- PO 29$_a$ | 2256 |
| 713849 | G$_{es}$$^m$CesT$_{es}$T$_{es}$$^m$C$_{es}$A$_{ds}$G$_{ds}$T$_{ds}$$^m$C$_{ds}$ A$_{ds}$T$_{ds}$G$_{ds}$A$_{ds}$$^m$C$_{ds}$T$_{ds}$T$_{es}$$^m$C$_{es}$$^m$C$_{es}$T$_{es}$ T$_{eo}$A$_{do}$'-GalNAc$_1$-29$_a$ | GalNAc$_1$- A$_d$ 29$_a$ | 2257 |
| 713850 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{eo}$$^m$C$_{eo}$$^m$C$_{es}$T$_{es}$T$_{eo}$ A$_{do}$'-GalNAc$_1$-29$_a$ | GalNac$_1$- A$_d$ 29$_a$ | 2257 |

Example 113

Antisense Oligonucleotides Targeting Kallikrein B, Plasma (Fletcher Factor) 1 Comprising a GalNAc Cluster The oligonucleotides in Table 121 were designed to target human kallikrein B, plasma (Fletcher factor) 1, or prekallikrein (PKK).

TABLE 121

| Sequences (5' to 3') | SEQ ID No. |
|---|---|
| GalNAc$_3$-3-T$_{es}$G$_{es}$$^m$C$_{es}$A$_{es}$A$_{es}$G$_{ds}$T$_{ds}$$^m$C$_{ds}$T$_{ds}$$^m$C$_{ds}$T$_{ds}$T$_{ds}$G$_{ds}$ G$_{ds}$$^m$C$_{ds}$A$_{es}$A$_{es}$A$_{es}$$^m$C$_{es}$A$_e$ | 570 |
| GalNAc$_3$-3-T$_{es}$G$_{eo}$$^m$C$_{eo}$A$_{eo}$A$_{eo}$G$_{ds}$T$_{ds}$$^m$C$_{ds}$T$_{ds}$$^m$C$_{ds}$T$_{ds}$T$_{ds}$G$_{ds}$ G$_{ds}$$^m$C$_{ds}$A$_{eo}$A$_{eo}$A$_{es}$$^m$C$_{es}$A$_e$ | 570 |
| GalNAc$_3$-7-T$_{es}$G$_{es}$$^m$C$_{es}$A$_{es}$A$_{es}$G$_{ds}$T$_{ds}$$^m$C$_{ds}$T$_{ds}$$^m$C$_{ds}$T$_{ds}$T$_{ds}$G$_{ds}$ G$_{ds}$$^m$C$_{ds}$A$_{es}$A$_{es}$A$_{es}$$^m$C$_{es}$A$_e$ | 570 |
| GalNAc$_3$-7-T$_{es}$G$_{eo}$$^m$C$_{eo}$A$_{eo}$A$_{eo}$G$_{ds}$T$_{ds}$$^m$C$_{ds}$T$_{ds}$$^m$C$_{ds}$T$_{ds}$T$_{ds}$G$_{ds}$ G$_{ds}$$^m$C$_{ds}$A$_{eo}$A$_{eo}$A$_{es}$$^m$C$_{es}$A$_e$ | 570 |
| GalNAc$_3$-10-T$_{es}$G$_{es}$$^m$C$_{es}$A$_{es}$A$_{es}$G$_{ds}$T$_{ds}$$^m$C$_{ds}$T$_{ds}$$^m$C$_{ds}$T$_{ds}$T$_{ds}$G$_{ds}$ G$_{ds}$$^m$C$_{ds}$A$_{es}$A$_{es}$A$_{es}$$^m$C$_{es}$A$_e$ | 570 |
| GalNAc$_3$-10-T$_{es}$G$_{eo}$$^m$C$_{eo}$A$_{eo}$A$_{eo}$G$_{ds}$T$_{ds}$$^m$C$_{ds}$T$_{ds}$$^m$C$_{ds}$T$_{ds}$T$_{ds}$G$_{ds}$ G$_{ds}$$^m$C$_{ds}$A$_{eo}$A$_{eo}$A$_{es}$$^m$C$_{es}$A$_e$ | 570 |
| GalNAc$_3$-13-T$_{es}$G$_{es}$$^m$C$_{es}$A$_{es}$A$_{es}$G$_{ds}$T$_{ds}$$^m$C$_{ds}$T$_{ds}$$^m$C$_{ds}$T$_{ds}$T$_{ds}$G$_{ds}$ G$_{ds}$$^m$C$_{ds}$A$_{es}$A$_{es}$A$_{es}$$^m$C$_{es}$A$_e$ | 570 |
| GalNAc$_3$-13-T$_{es}$G$_{eo}$$^m$C$_{eo}$A$_{eo}$A$_{eo}$G$_{ds}$T$_{ds}$$^m$C$_{ds}$T$_{ds}$$^m$C$_{ds}$T$_{ds}$T$_{ds}$G$_{ds}$ G$_{ds}$$^m$C$_{ds}$A$_{eo}$A$_{eo}$A$_{es}$$^m$C$_{es}$A$_e$ | 570 |
| T$_{es}$G$_{es}$$^m$C$_{es}$A$_{es}$A$_{es}$G$_{ds}$T$_{ds}$$^m$C$_{ds}$T$_{ds}$$^m$C$_{ds}$T$_{ds}$T$_{ds}$G$_{ds}$G$_{ds}$$^m$C$_{ds}$A$_{es}$A$_{es}$ A$_{es}$$^m$C$_{es}$A$_e$-GalNAc$_3$-19 | 570 |
| T$_{es}$G$_{eo}$$^m$C$_{eo}$A$_{eo}$A$_{eo}$G$_{ds}$T$_{ds}$$^m$C$_{ds}$T$_{ds}$$^m$C$_{ds}$T$_{ds}$T$_{ds}$G$_{ds}$G$_{ds}$$^m$C$_{ds}$A$_{eo}$A$_{eo}$ A$_{es}$$^m$C$_{es}$A$_e$-GalNAc$_3$-19 | 570 |
| GalNAc$_3$-7$_{a-o}$,T$_{es}$G$_{es}$$^m$C$_{eo}$A$_{eo}$A$_{es}$G$_{ds}$T$_{ds}$$^m$C$_{ds}$T$_{ds}$$^m$C$_{ds}$T$_{ds}$T$_{ds}$G$_{ds}$ G$_{ds}$$^m$C$_{ds}$A$_{eo}$A$_{es}$$^m$C$_{es}$A$_e$ | 570 |

Example 114

Antisense Inhibition of Human PKK in HepaRG™$^T$ Cells by Antisense Oligonucleotides with 2'-MOE Sugar Modifications Antisense oligonucleotides were designed targeting a PKK nucleic acid and were tested for their effects on PKK mRNA in vitro. HepaRG™ cells, which are terminally differentiated hepatic cells derived from a human hepatic progenitor cell line and retain many characteristics of primary human hepatocytes (Lubberstedt M. et al., J. Pharmacol. Toxicol. Methods 2011 63: 59-68), were used in the screen.

The chimeric antisense oligonucleotides in the tables below were designed as 5-10-5 MOE gapmers. The gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-O-methoxyethyl modification. The internucleoside linkages throughout each gapmer are phosphorothioate linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted in the human gene sequence. Each gapmer listed in the tables below is targeted to either the human PKK mRNA, designated herein as SEQ ID NO: 1 (GENBANK Accession No. NM_000892.3) or the human PKK genomic sequence, designated herein as SEQ ID NO: 10 (GENBANK Accession No. NT_016354.19 truncated from nucleotides 111693001 to 11730000). 'n/a' indicates that the antisense oligonucleotide does not target that particular gene sequence.

Cultured HepaRG™ cells at a density of 20,000 cells per well were transfected using electroporation with 3,000 nM antisense oligonucleotide. After a treatment period of approximately 24 hours, RNA was isolated from the cells and PKK mRNA levels were measured by quantitative real-time PCR. Human primer probe set RTS3454 (forward sequence CCAAAAAAGGTGCACCAGTAACA, designated herein as SEQ ID NO: 20; reverse sequence CCTCCGGGACTGTACTTTAATAGG, designated herein as SEQ ID NO: 21; probe sequence CACGCAAACATTTCACAAGGCAGAGTACC, designated herein as SEQ ID NO: 22) was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells.

TABLE 122

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 530929 | 1 | 20 | AACGGTCTTCAAGCTGTTCT | 59 | 3393 | 3412 | 30 |
| 530930 | 6 | 25 | AAATGAACGGTCTTCAAGCT | 17 | 3398 | 3417 | 31 |
| 530931 | 11 | 30 | CTTAAAAATGAACGGTCTTC | 29 | 3403 | 3422 | 32 |
| 530932 | 16 | 35 | TGTCACTTAAAAATGAACGG | 52 | 3408 | 3427 | 33 |
| 530933 | 31 | 50 | TGGAGGTGAGTCTCTTGTCA | 76 | 3423 | 3442 | 34 |
| 530934 | 36 | 55 | CTTCTTGGAGGTGAGTCTCT | 54 | 3428 | 3447 | 35 |
| 530935 | 68 | 87 | GCTTGAATAAAATCATTCTG | 0 | n/a | n/a | 36 |
| 530936 | 73 | 92 | TGCTTGCTTGAATAAAATCA | 27 | 4072 | 4091 | 37 |
| 530937 | 78 | 97 | TAAGTTGCTTGCTTGAATAA | 0 | 4077 | 4096 | 38 |
| 530938 | 88 | 107 | GGAAATGAAATAAGTTGCTT | 11 | 4087 | 4106 | 39 |
| 530939 | 93 | 112 | AACAAGGAAATGAAATAAGT | 0 | 4092 | 4111 | 40 |
| 530940 | 98 | 117 | TAGCAAACAAGGAAATGAAA | 7 | 4097 | 4116 | 41 |
| 530941 | 103 | 122 | AACTGTAGCAAACAAGGAAA | 22 | 4102 | 4121 | 42 |
| 530942 | 108 | 127 | CAGGAAACTGTAGCAAACAA | 22 | 4107 | 4126 | 43 |
| 530943 | 113 | 132 | ATCCACAGGAAACTGTAGCA | 56 | n/a | n/a | 44 |
| 530944 | 118 | 137 | CAGACATCCACAGGAAACTG | 0 | n/a | n/a | 45 |
| 530945 | 157 | 176 | ATCCCCACCTCTGAAGAAGG | 0 | 8029 | 8048 | 46 |
| 530946 | 160 | 179 | TACATCCCCACCTCTGAAGA | 0 | 8032 | 8051 | 47 |
| 530947 | 165 | 184 | GAAGCTACATCCCCACCTCT | 27 | 8037 | 8056 | 48 |
| 530948 | 170 | 189 | ACATGGAAGCTACATCCCCA | 35 | 8042 | 8061 | 49 |
| 530949 | 175 | 194 | GGTGTACATGGAAGCTACAT | 31 | 8047 | 8066 | 50 |
| 530950 | 221 | 240 | ACCTTGGGTGGAATGTGCAC | 47 | 8093 | 8112 | 51 |
| 530951 | 226 | 245 | CAAACACCTTGGGTGGAATG | 49 | 8098 | 8117 | 52 |
| 530952 | 234 | 253 | CTGAATAGCAAACACCTTGG | 38 | 8106 | 8125 | 53 |
| 530953 | 239 | 258 | GAAAACTGAATAGCAAACAC | 7 | 8111 | 8130 | 54 |
| 530954 | 244 | 263 | TGGAAGAAAACTGAATAGCA | 47 | 8116 | 8135 | 55 |
| 530955 | 278 | 297 | CAAACCTTTTCTCCATGTCA | 55 | n/a | n/a | 56 |
| 530956 | 300 | 319 | ACACTATCTTTCAAGAAGCA | 57 | 9834 | 9853 | 57 |

TABLE 122-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 530957 | 386 | 405 | GGCAAGCACTTATTTGATGA | 56 | n/a | n/a | 58 |
| 530958 | 432 | 451 | TTAAAATTGACTCCTCTCAT | 60 | 12688 | 12707 | 59 |
| 530959 | 456 | 475 | TCAACACTGCTAACCTTAGA | 60 | 12712 | 12731 | 60 |
| 530960 | 461 | 480 | ATTCTTCAACACTGCTAACC | 58 | 12717 | 12736 | 61 |
| 530961 | 466 | 485 | TTGGCATTCTTCAACACTGC | 88 | 12722 | 12741 | 62 |
| 530962 | 472 | 491 | CCTTTTTTGGCATTCTTCAA | 64 | 12728 | 12747 | 63 |
| 530963 | 479 | 498 | TGGTGCACCTTTTTTGGCAT | 78 | 12735 | 12754 | 64 |
| 530964 | 628 | 647 | CTTCAGTGAGAATCCAGATT | 44 | 14199 | 14218 | 65 |
| 530965 | 637 | 656 | GGCACAGGGCTTCAGTGAGA | 73 | 14208 | 14227 | 66 |
| 530966 | 649 | 668 | AATTTCTGAAAGGGCACAGG | 58 | 14220 | 14239 | 67 |
| 530967 | 654 | 673 | CAACCAATTTCTGAAAGGGC | 69 | n/a | n/a | 68 |
| 530968 | 680 | 699 | CAAGATGCTGGAAGATGTTC | 18 | 26128 | 26147 | 69 |
| 530969 | 846 | 865 | GTGCCACTTTCAGATGTTTT | 0 | 27110 | 27129 | 70 |
| 530970 | 851 | 870 | TTGGTGTGCCACTTTCAGAT | 74 | 27115 | 27134 | 71 |
| 530971 | 856 | 875 | GGAACTTGGTGTGCCACTTT | 85 | 27120 | 27139 | 72 |
| 530972 | 861 | 880 | GTAGAGGAACTTGGTGTGCC | 42 | 27125 | 27144 | 73 |
| 530973 | 866 | 885 | GAGGAGTAGAGGAACTTGGT | 52 | 27130 | 27149 | 74 |
| 530974 | 871 | 890 | TTCTTGAGGAGTAGAGGAAC | 18 | 27135 | 27154 | 75 |
| 530975 | 876 | 895 | GTGTTTTCTTGAGGAGTAGA | 41 | 27140 | 27159 | 76 |
| 530976 | 881 | 900 | ATATGGTGTTTTCTTGAGGA | 26 | 27145 | 27164 | 77 |
| 530977 | 886 | 905 | TCCAGATATGGTGTTTTCTT | 55 | 27150 | 27169 | 78 |
| 530978 | 891 | 910 | CTATATCCAGATATGGTGTT | 0 | 27155 | 27174 | 79 |
| 530979 | 901 | 920 | GGTTAAAAGGCTATATCCAG | 35 | 27165 | 27184 | 80 |
| 530980 | 906 | 925 | TTGCAGGTTAAAAGGCTATA | 29 | 27170 | 27189 | 81 |
| 530981 | 911 | 930 | TTCTTTTGCAGGTTAAAAGG | 0 | 27175 | 27194 | 82 |
| 530982 | 916 | 935 | TAAAGTTCTTTTGCAGGTTA | 0 | 27180 | 27199 | 83 |
| 530983 | 931 | 950 | ATGGCAGGGTTCAGGTAAAG | 9 | n/a | n/a | 84 |
| 530984 | 936 | 955 | TTAGAATGGCAGGGTTCAGG | 25 | n/a | n/a | 85 |
| 530985 | 941 | 960 | AAATTTTAGAATGGCAGGGT | 32 | 27363 | 27382 | 86 |
| 530986 | 946 | 965 | CGGGTAAATTTTAGAATGGC | 62 | 27368 | 27387 | 87 |
| 530987 | 951 | 970 | ACTCCCGGGTAAATTTTAGA | 0 | 27373 | 27392 | 88 |
| 530988 | 961 | 980 | TCCAAAGTCAACTCCCGGGT | 76 | 27383 | 27402 | 89 |
| 530989 | 966 | 985 | TCTCCTCCAAAGTCAACTCC | 28 | 27388 | 27407 | 90 |
| 530990 | 971 | 990 | ATTCTTCTCCTCCAAAGTCA | 32 | 27393 | 27412 | 91 |
| 530991 | 976 | 995 | ATTCAATTCTTCTCCTCCAA | 43 | 27398 | 27417 | 92 |
| 530992 | 981 | 1000 | GTCACATTCAATTCTTCTCC | 70 | 27403 | 27422 | 93 |
| 530993 | 1005 | 1024 | CAAACATTCACTCCTTTAAC | 30 | 27427 | 27446 | 94 |

TABLE 122-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 530994 | 1010 | 1029 | CTTGGCAAACATTCACTCCT | 50 | 27432 | 27451 | 95 |
| 530995 | 1015 | 1034 | AGTCTCTTGGCAAACATTCA | 49 | 27437 | 27456 | 96 |
| 530996 | 1038 | 1057 | TGACAGCGAATCATCTTTGT | 51 | 27460 | 27479 | 97 |
| 530997 | 1043 | 1062 | AAAACTGACAGCGAATCATC | 39 | 27465 | 27484 | 98 |
| 530998 | 1048 | 1067 | AGTGAAAAACTGACAGCGAA | 0 | 27470 | 27489 | 99 |
| 530999 | 1071 | 1090 | CAGTCTTCTGGGAGTAAAGA | 31 | 27493 | 27512 | 100 |
| 531000 | 1098 | 1117 | AAGAAACACTTACACTTCTC | 1 | n/a | n/a | 101 |
| 531001 | 1108 | 1127 | AGATAATCTTAAGAAACACT | 44 | 27629 | 27648 | 102 |
| 531002 | 1155 | 1174 | GAGCTCCCTTGTGTCCCATA | 85 | 27676 | 27695 | 103 |
| 531003 | 1160 | 1179 | AACCAGAGCTCCCTTGTGTC | 49 | 27681 | 27700 | 104 |
| 531004 | 1165 | 1184 | AGAGTAACCAGAGCTCCCTT | 76 | 27686 | 27705 | 105 |
| 531005 | 1170 | 1189 | CTCAAAGAGTAACCAGAGCT | 76 | 27691 | 27710 | 106 |
| 531006 | 1216 | 1235 | GCTTGTTTTTGTTGTGCAGA | 49 | 27892 | 27911 | 107 |

TABLE 123

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 482586 | 1608 | 1627 | ACCCAACAGTTGGTATAAAT | 0 | 31914 | 31933 | 108 |
| 486847 | 1563 | 1582 | AGGCATATTGGTTTTTGGAA | 78 | 31869 | 31888 | 109 |
| 531007 | 46 | 65 | AACACAATTGCTTCTTGGAG | 51 | 3438 | 3457 | 110 |
| 531008 | 675 | 694 | TGCTGGAAGATGTTCATGTG | 51 | 26123 | 26142 | 111 |
| 531009 | 1239 | 1258 | TTTGTTCCTCCAACAATGCG | 65 | 27915 | 27934 | 112 |
| 531010 | 1244 | 1263 | AAGAGTTTGTTCCTCCAACA | 52 | 27920 | 27939 | 113 |
| 531011 | 1249 | 1268 | CCAAGAAGAGTTTGTTCCTC | 0 | 27925 | 27944 | 114 |
| 531012 | 1254 | 1273 | TCTCCCCAAGAAGAGTTTGT | 48 | 27930 | 27949 | 115 |
| 531013 | 1264 | 1283 | CCAGGGCCACTCTCCCCAAG | 56 | 27940 | 27959 | 116 |
| 531014 | 1287 | 1306 | AGCTTCACCTGCAGGCTCAC | 0 | 27963 | 27982 | 117 |
| 531015 | 1324 | 1343 | TATGAGTGACCCTCCACACA | 52 | 28000 | 28019 | 118 |
| 531016 | 1329 | 1348 | TGTCCTATGAGTGACCCTCC | 39 | 28005 | 28024 | 119 |
| 531017 | 1334 | 1353 | ACTGGTGTCCTATGAGTGAC | 31 | 28010 | 28029 | 120 |
| 531018 | 1339 | 1358 | GACCCACTGGTGTCCTATGA | 54 | 28015 | 28034 | 121 |
| 531019 | 1344 | 1363 | GTGAGGACCCACTGGTGTCC | 28 | 28020 | 28039 | 122 |
| 531020 | 1369 | 1388 | AAGCCCATCAAAGCAGTGGG | 0 | n/a | n/a | 123 |
| 531021 | 1420 | 1439 | GTCTGACAGATTTAAAATGC | 50 | 30498 | 30517 | 124 |
| 531022 | 1425 | 1444 | GTAATGTCTGACAGATTTAA | 74 | 30503 | 30522 | 125 |
| 531023 | 1430 | 1449 | CTTTTGTAATGTCTGACAGA | 71 | 30508 | 30527 | 126 |
| 531024 | 1452 | 1471 | TTTATTTGTGAGAAAGGTGT | 69 | 30530 | 30549 | 127 |

TABLE 123-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531025 | 1457 | 1476 | TCTCTTTTATTTGTGAGAAA | 34 | 30535 | 30554 | 128 |
| 531026 | 1501 | 1520 | ATCATGATTCCCTTCTGAGA | 73 | 30579 | 30598 | 129 |
| 531027 | 1530 | 1549 | AAAGGAGCCTGGAGTTTTAT | 0 | 30608 | 30627 | 130 |
| 531028 | 1535 | 1554 | AATTCAAAGGAGCCTGGAGT | 56 | 30613 | 30632 | 131 |
| 531029 | 1540 | 1559 | AGTGTAATTCAAAGGAGCCT | 59 | 30618 | 30637 | 132 |
| 531030 | 1545 | 1564 | AATTCAGTGTAATTCAAAGG | 24 | n/a | n/a | 133 |
| 531031 | 1550 | 1569 | TTTGGAATTCAGTGTAATTC | 59 | n/a | n/a | 134 |
| 531032 | 1555 | 1574 | TGGTTTTTGGAATTCAGTGT | 67 | n/a | n/a | 135 |
| 531033 | 1557 | 1576 | ATTGGTTTTTGGAATTCAGT | 53 | n/a | n/a | 136 |
| 531034 | 1560 | 1579 | CATATTGGTTTTTGGAATTC | 36 | 31866 | 31885 | 137 |
| 531035 | 1565 | 1584 | GTAGGCATATTGGTTTTTGG | 46 | 31871 | 31890 | 138 |
| 531036 | 1581 | 1600 | GTGTCACCTTTGGAAGGTAG | 71 | 31887 | 31906 | 139 |
| 531037 | 1604 | 1623 | AACAGTTGGTATAAATTGTG | 35 | 31910 | 31929 | 140 |
| 531038 | 1605 | 1624 | CAACAGTTGGTATAAATTGT | 22 | 31911 | 31930 | 141 |
| 531039 | 1609 | 1628 | TACCCAACAGTTGGTATAAA | 36 | 31915 | 31934 | 142 |
| 531040 | 1632 | 1651 | TCCTTCGAGAAGCCCCATCC | 27 | 31938 | 31957 | 143 |
| 531041 | 1677 | 1696 | AAAGGAATATTTACCTTTTG | 68 | 33121 | 33140 | 144 |
| 531042 | 1682 | 1701 | TTACCAAAGGAATATTTACC | 11 | 33126 | 33145 | 145 |
| 531043 | 1687 | 1706 | ATTTGTTACCAAAGGAATAT | 27 | 33131 | 33150 | 146 |
| 531044 | 1697 | 1716 | GGCATTCTTCATTTGTTACC | 68 | 33141 | 33160 | 147 |
| 531045 | 1702 | 1721 | TTTCTGGCATTCTTCATTTG | 37 | 33146 | 33165 | 148 |
| 531046 | 1709 | 1728 | GATATCTTTTCTGGCATTCT | 54 | 33153 | 33172 | 149 |
| 531047 | 1714 | 1733 | ATCTTGATATCTTTTCTGGC | 68 | 33158 | 33177 | 150 |
| 531048 | 1719 | 1738 | TTATAATCTTGATATCTTTT | 42 | 33163 | 33182 | 151 |
| 531049 | 1724 | 1743 | TTATTTTATAATCTTGATAT | 2 | 33168 | 33187 | 152 |
| 531050 | 1729 | 1748 | TTGGGTTATTTTATAATCTT | 18 | 33173 | 33192 | 153 |
| 531051 | 1734 | 1753 | ATCCGTTGGGTTATTTTATA | 51 | 33178 | 33197 | 154 |
| 531052 | 1739 | 1758 | AGACCATCCGTTGGGTTATT | 60 | 33183 | 33202 | 155 |
| 531053 | 1744 | 1763 | AGCACAGACCATCCGTTGGG | 49 | 33188 | 33207 | 156 |
| 531054 | 1754 | 1773 | CTTTATAGCCAGCACAGACC | 48 | 33198 | 33217 | 157 |
| 531055 | 1759 | 1778 | CCCTTCTTTATAGCCAGCAC | 68 | 33203 | 33222 | 158 |
| 531056 | 1764 | 1783 | TTTCCCCCTTCTTTATAGCC | 45 | 33208 | 33227 | 159 |
| 531057 | 1769 | 1788 | CATCTTTTCCCCCTTCTTTA | 48 | 33213 | 33232 | 160 |
| 531058 | 1779 | 1798 | CCCTTACAAGCATCTTTTCC | 60 | n/a | n/a | 161 |
| 531059 | 1820 | 1839 | ACATTCCATTGTGTTTGCAA | 55 | 33919 | 33938 | 162 |
| 531060 | 1841 | 1860 | TGGTGATGCCCACCAAACGC | 35 | 33940 | 33959 | 163 |
| 531061 | 1872 | 1891 | TGCTCCCTGCGGGCACAGCC | 52 | 33971 | 33990 | 164 |

TABLE 123-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531062 | 1877 | 1896 | CAGGTTGCTCCCTGCGGGCA | 39 | 33976 | 33995 | 165 |
| 531063 | 1882 | 1901 | GACACCAGGTTGCTCCCTGC | 51 | 33981 | 34000 | 166 |
| 531064 | 1887 | 1906 | GTGTAGACACCAGGTTGCTC | 56 | 33986 | 34005 | 167 |
| 531065 | 1892 | 1911 | CTTTGGTGTAGACACCAGGT | 57 | 33991 | 34010 | 168 |
| 531066 | 1897 | 1916 | AGCGACTTTGGTGTAGACAC | 67 | 33996 | 34015 | 169 |
| 531067 | 1902 | 1921 | TACTCAGCGACTTTGGTGTA | 31 | 34001 | 34020 | 170 |
| 531068 | 1907 | 1926 | CCATGTACTCAGCGACTTTG | 59 | 34006 | 34025 | 171 |
| 531069 | 1912 | 1931 | CCAGTCCATGTACTCAGCGA | 56 | 34011 | 34030 | 172 |
| 531070 | 1930 | 1949 | CTGTGTTTTCTCTAAAATCC | 68 | 34029 | 34048 | 173 |
| 531071 | 1935 | 1954 | CTGCTCTGTGTTTTCTCTAA | 73 | 34034 | 34053 | 174 |
| 531072 | 2026 | 2045 | GCTCAGAATTTGACTTGAAC | 64 | 34125 | 34144 | 175 |
| 531073 | 2031 | 2050 | CCCAGGCTCAGAATTTGACT | 51 | 34130 | 34149 | 176 |
| 531074 | 2049 | 2068 | CTTTGCAGATGAGGACCCCC | 67 | 34148 | 34167 | 177 |
| 531075 | 2054 | 2073 | CCATGCTTTGCAGATGAGGA | 64 | 34153 | 34172 | 178 |
| 531076 | 2059 | 2078 | ACTCTCCATGCTTTGCAGAT | 68 | 34158 | 34177 | 179 |
| 531077 | 2064 | 2083 | ATGCCACTCTCCATGCTTTG | 51 | 34163 | 34182 | 180 |
| 531078 | 2111 | 2130 | AGCAGCTCTGAGTGCACTGT | 77 | 34210 | 34229 | 181 |
| 531079 | 2116 | 2135 | TCCTCAGCAGCTCTGAGTGC | 58 | 34215 | 34234 | 182 |
| 531080 | 2121 | 2140 | CATTGTCCTCAGCAGCTCTG | 55 | 34220 | 34239 | 183 |
| 531081 | n/a | n/a | TGGTTTTTGGAATTCTGAAA | 14 | 31861 | 31880 | 184 |
| 531082 | n/a | n/a | ATATTGGTTTTTGGAATTCT | 31 | 31865 | 31884 | 185 |

TABLE 124

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531083 | n/a | n/a | TGTACTAGTTTCCTATAACT | 60 | 14738 | 14757 | 186 |
|  |  |  |  |  | 14809 | 14828 |  |
|  |  |  |  |  | 14880 | 14899 |  |
|  |  |  |  |  | 14909 | 14958 |  |
|  |  |  |  |  | 15071 | 15090 |  |
|  |  |  |  |  | 15214 | 15233 |  |
|  |  |  |  |  | 15286 | 15305 |  |
|  |  |  |  |  | 15345 | 15364 |  |
|  |  |  |  |  | 15477 | 15496 |  |
|  |  |  |  |  | 15549 | 15568 |  |
|  |  |  |  |  | 15607 | 15626 |  |
|  |  |  |  |  | 15679 | 15698 |  |
|  |  |  |  |  | 15809 | 15828 |  |
|  |  |  |  |  | 15881 | 15900 |  |
|  |  |  |  |  | 15939 | 15958 |  |
| 531084 | n/a | n/a | ATAGGGACACAACCAAGGAA | 25 | 16296 | 16315 | 187 |
| 531085 | n/a | n/a | AGGCACAGAGCCAGCACCCA | 9 | 16495 | 16514 | 188 |
| 531086 | n/a | n/a | CCTGCCTCCTGGCAGCCTTC | 48 | 16696 | 16715 | 189 |
| 531087 | n/a | n/a | CCAGGTGTGGACAGCAGCTG | 52 | 16821 | 16840 | 190 |

TABLE 124-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531088 | n/a | n/a | GGTTTTGTTTGTAAAATTAG | 27 | 17159 | 17178 | 191 |
| 531089 | n/a | n/a | AAAACACCATTAAATCCATT | 45 | 17306 | 17325 | 192 |
| 531090 | n/a | n/a | ACAGAAACCATGATGTTGCT | 59 | 17644 | 17663 | 193 |
| 531091 | n/a | n/a | TCAGCCCAATGTCCTAACCT | 35 | 17793 | 17812 | 194 |
| 531092 | n/a | n/a | CCTTCACTGACTCTCTTTTC | 24 | 17922 | 17941 | 195 |
| 531093 | n/a | n/a | TTCTCCTGGCTCAGAAGCTC | 60 | 18053 23315 | 18072 23334 | 196 |
| 531094 | n/a | n/a | GAATGTCAGGCCTCTGGGCC | 48 | 18181 | 18200 | 197 |
| 531095 | n/a | n/a | CTAACAACCCCACAATATCA | 20 | 18390 | 18409 | 198 |
| 531096 | n/a | n/a | CCCAATTCTTAGTCCTTTAA | 45 | 18523 | 18542 | 199 |
| 531097 | n/a | n/a | ACCAAGCTCAGCCTCCAACT | 41 | 18648 | 18667 | 200 |
| 531098 | n/a | n/a | TTATTAGTCAAATCACCCAA | 19 | 18773 | 18792 | 201 |
| 531099 | n/a | n/a | TGGATGGGTAGAGGCCTTTC | 64 | 18898 | 18917 | 202 |
| 531100 | n/a | n/a | CCCCCTCCCTTCCCTACACA | 0 | 19023 | 19042 | 203 |
| 531101 | n/a | n/a | ATGTAAGTTACAAGCCACTA | 37 | 19153 | 19172 | 204 |
| 531102 | n/a | n/a | TGCCTCTTTAATAAAAACTC | 42 | 19484 | 19503 | 205 |
| 531103 | n/a | n/a | ACTCATTGCCTTAACTCAGG | 40 | 19636 | 19655 | 206 |
| 531104 | n/a | n/a | ACTTGACCTTACTGTTTTAG | 20 | 19886 | 19905 | 207 |
| 531105 | n/a | n/a | CTCCTCCCCAGGCTGCTCCT | 16 | 22092 | 22111 | 208 |
| 531106 | n/a | n/a | AAGATCTAGATAATTCTTGT | 31 | 22332 | 22351 | 209 |
| 531107 | n/a | n/a | TCAACTCACACCTGACCTAA | 30 | 22457 | 22476 | 210 |
| 531108 | n/a | n/a | TGAACCCAAAACTCTGGCAC | 50 | 22771 | 22790 | 211 |
| 531109 | n/a | n/a | AGCCCAAGGAACATCTCACC | 52 | 22959 | 22978 | 212 |
| 531110 | n/a | n/a | GCCTGTTTGGTGGTCTCTTC | 86 | 23110 | 23129 | 213 |
| 531111 | n/a | n/a | CTTCTCCTGGCTCAGAAGCT | 68 | 18054 23316 | 18073 23335 | 214 |
| 531112 | n/a | n/a | ATGTATGATTCTAAGAACTT | 14 | 23479 | 23498 | 215 |
| 531113 | n/a | n/a | AACAGACACATTATTTATAT | 0 | 23604 | 23623 | 216 |
| 531114 | n/a | n/a | AGAGTCAAGTCCACAGACAT | 40 | 24246 | 24265 | 217 |
| 531115 | n/a | n/a | TCCTAAATAGGAACAAAGTA | 0 | 24372 | 24391 | 218 |
| 531116 | n/a | n/a | TTGTTAAGGTTGTAGAGAGA | 23 | 24688 | 24707 | 219 |
| 531117 | n/a | n/a | ACCCAATTATTTTTAATGGC | 62 | 24876 | 24895 | 220 |
| 531118 | n/a | n/a | GCCTAAATGTAAGAGCTAAA | 26 | 25157 | 25176 | 221 |
| 531119 | n/a | n/a | TAAACTCTTACATTTATAGA | 0 | 25293 | 25312 | 222 |
| 531120 | n/a | n/a | AAATAAAAGCACTCAGACTG | 0 | 25418 | 25437 | 223 |
| 531121 | n/a | n/a | TTGGTCTACAGATTCAATGC | 72 | 25550 | 25569 | 224 |
| 531122 | n/a | n/a | TAACAAAAATGCCTTGTGCC | 33 | 25710 | 25729 | 225 |
| 531123 | n/a | n/a | TCCCAGCTCCAGTCACCACC | 74 | 25866 | 25885 | 226 |

TABLE 124-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531124 | n/a | n/a | GTACTAAACATCCTAAGTGA | 2 | 25992 | 26011 | 227 |
| 531125 | n/a | n/a | ACTCGCCTTTGTGACTCGAT | 23 | 26264 | 26283 | 228 |
| 531126 | n/a | n/a | TTTTGAATCTTCATTCAAAG | 0 | 26551 | 26570 | 229 |
| 531127 | n/a | n/a | CAGAGCCTTGATCAGAATAA | 12 | 26676 | 26695 | 230 |
| 531128 | n/a | n/a | AAGTTCCACCTTCTAACTGG | 18 | 26831 | 26850 | 231 |
| 531129 | n/a | n/a | AGCAGCTCACACCCAAAAAG | 0 | 27005 | 27024 | 232 |
| 531130 | n/a | n/a | TTCTGTGTCAATTATAAACA | 0 | 27344 | 27363 | 233 |
| 531131 | n/a | n/a | TAGAAAGAGTAAGCCTTCAC | 0 | 27587 | 27606 | 234 |
| 531132 | n/a | n/a | AGTGAGGTTACTCACCAGAG | 0 | 27732 | 27751 | 235 |
| 531133 | n/a | n/a | TTTTGTTGTGCAGACTGAAA | 19 | 27886 | 27905 | 236 |
| 531134 | n/a | n/a | TTACCCATCAAAGCAGTGGG | 6 | 28045 | 28064 | 237 |
| 531135 | n/a | n/a | AATGTTGTGAATACCATCCC | 16 | 28174 | 28193 | 238 |
| 531136 | n/a | n/a | TAACATTTCTATGGGCCTGA | 6 | 28670 | 28689 | 239 |
| 531137 | n/a | n/a | TGTCTACTATTTGACCAATA | 19 | 28795 | 28814 | 240 |
| 531138 | n/a | n/a | TTTAAATGTGTCACTTAATC | 0 | 28987 | 29006 | 241 |
| 531139 | n/a | n/a | TCACTAAAACAAAAATACTT | 0 | 29156 | 29175 | 242 |
| 531140 | n/a | n/a | TCTTCCAGGCCAACCACCTT | 22 | 29321 | 29340 | 243 |
| 531141 | n/a | n/a | TGCAAGGCATGTGTGCACAA | 47 | 29532 | 29551 | 244 |
| 531142 | n/a | n/a | TGTTTAAAATATCTCTATAC | 8 | 30008 | 30027 | 245 |
| 531143 | n/a | n/a | CATGGAAAAATTAAGCTCAT | 0 | 30133 | 30152 | 246 |
| 531144 | n/a | n/a | TGAAGATTCTATTTAACAAA | 0 | 30266 | 30285 | 247 |
| 531145 | n/a | n/a | GCCTAGGAGAGAAAAATAAA | 0 | 30445 | 30464 | 248 |
| 531146 | n/a | n/a | CCAGTGTAATTCAAAGGAGC | 40 | 30620 | 30639 | 249 |
| 531147 | n/a | n/a | CCATTATTTCCATCACCTGC | 18 | 30871 | 30890 | 250 |
| 531148 | n/a | n/a | TACCCAAATTATACCTGGAA | 8 | 31015 | 31034 | 251 |
| 531149 | n/a | n/a | AGAGGTAAAGCAACTTGCCC | 45 | 31429 | 31448 | 252 |
| 531150 | n/a | n/a | TCCTTAATAGTCATAGCAGG | 48 | 31558 | 31577 | 253 |
| 531151 | n/a | n/a | TCACCACCATTTTTCACATG | 44 | 31683 | 31702 | 254 |
| 531152 | n/a | n/a | GTTATGGATATAGACTTTAA | 0 | 31808 | 31827 | 255 |
| 531153 | n/a | n/a | CTAGAAGCAATATTTAAAGC | 0 | 31974 | 31993 | 256 |
| 531154 | n/a | n/a | ATGAAGTAAGATGCTTAAAA | 16 | 32162 | 32181 | 257 |
| 531155 | n/a | n/a | CTTCTTGTCTCAGATTACCA | 79 | 32464 | 32483 | 258 |
| 531156 | n/a | n/a | TCTGAAAAGCCCTCCGAGCT | 0 | 32589 | 32608 | 259 |
| 531157 | n/a | n/a | AAGTGAATCAGAGCAGTGTA | 46 | 32961 | 32980 | 260 |
| 531158 | n/a | n/a | ACCTTACAAGCATCTTTTCC | 41 | 33223 | 33242 | 261 |
| 531159 | n/a | n/a | ATTTGTTAAAAGTTGCTTAT | 0 | 33368 | 33387 | 262 |
| 531160 | n/a | n/a | TGATATCATCATCCCAATGA | 13 | 33510 | 33529 | 263 |

TABLE 125

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531083 | n/a | n/a | TGTACTAGTTTCCTATAACT | 68 | 14738 | 14757 | 264 |
|  |  |  |  |  | 14809 | 14828 |  |
|  |  |  |  |  | 14880 | 14899 |  |
|  |  |  |  |  | 14939 | 14958 |  |
|  |  |  |  |  | 15071 | 15090 |  |
|  |  |  |  |  | 15214 | 15233 |  |
|  |  |  |  |  | 15286 | 15305 |  |
|  |  |  |  |  | 15345 | 15364 |  |
|  |  |  |  |  | 15477 | 15496 |  |
|  |  |  |  |  | 15549 | 15568 |  |
|  |  |  |  |  | 15607 | 15626 |  |
|  |  |  |  |  | 15679 | 15698 |  |
|  |  |  |  |  | 15809 | 15828 |  |
|  |  |  |  |  | 15881 | 15900 |  |
|  |  |  |  |  | 15939 | 15958 |  |
| 531161 | n/a | n/a | CAGACACCTTCTTCACAAGG | 40 | 898 | 917 | 264 |
| 531162 | n/a | n/a | AATTTCCCAGATGTATTAGT | 43 | 1054 | 1073 | 265 |
| 531163 | n/a | n/a | TCAGCAGAAATCATGTAGGC | 60 | 1181 | 1200 | 266 |
| 531164 | n/a | n/a | TTAAATATAAAGAGATCCTC | 38 | 1609 | 1628 | 267 |
| 531165 | n/a | n/a | GTAATAAAAGGAATGATAAA | 0 | 1825 | 1844 | 268 |
| 531166 | n/a | n/a | AGACAGTAAACAAAATCAGG | 12 | 2046 | 2065 | 269 |
| 531167 | n/a | n/a | CAAGAAACCACCAAAGGAAG | 37 | 2176 | 2195 | 270 |
| 531168 | n/a | n/a | ACCCCAACAGACAGCCCACC | 55 | 2314 | 2333 | 271 |
| 531169 | n/a | n/a | TGGGCTCACCCCAGTGGACC | 54 | 2580 | 2599 | 272 |
| 531170 | n/a | n/a | GCCTGGCCCCAAGACTCTA | 54 | 2743 | 2762 | 273 |
| 531171 | n/a | n/a | AGGCCTGCCACAGGCCAGAC | 40 | 2873 | 2892 | 274 |
| 531172 | n/a | n/a | TTCAAGCCTGGGCAGCACAG | 71 | 3004 | 3023 | 275 |
| 531173 | n/a | n/a | AAAATAACTTCACTAGAGCT | 22 | 3131 | 3150 | 276 |
| 531174 | n/a | n/a | TGTTAAGTATATTAACTATT | 10 | 3256 | 3275 | 277 |
| 531175 | n/a | n/a | TACTCAGGAAATTAGAATAT | 25 | 3550 | 3569 | 278 |
| 531176 | n/a | n/a | TTATGAAACCTCTTGATTTG | 0 | 3753 | 3772 | 279 |
| 531177 | n/a | n/a | TTCTTGTAAATGTCTGAATT | 61 | 3971 | 3990 | 280 |
| 531178 | n/a | n/a | ACCACAGGAAACTGTAGCAA | 72 | 4111 | 4130 | 281 |
| 531179 | n/a | n/a | GATTGGACCCAGACACTATA | 57 | 4506 | 4525 | 282 |
| 531180 | n/a | n/a | CCTCTTAAGTCACCATAGAC | 45 | 4785 | 4804 | 283 |
| 531181 | n/a | n/a | GGTTGAGGGACAGACACAGG | 36 | 4940 | 4959 | 284 |
| 531182 | n/a | n/a | ATAATCATGATTATTTTGC | 34 | 5099 | 5118 | 285 |
| 531183 | n/a | n/a | CATAAGAATGTGCACACAAA | 39 | 5382 | 5401 | 286 |
| 531184 | n/a | n/a | ACTCTTATTAGCTGGTAGAA | 74 | 5538 | 5557 | 287 |
| 531185 | n/a | n/a | GGACCAAAACTGAGAGGCAG | 63 | 5663 | 5682 | 288 |
| 531186 | n/a | n/a | CCATTACTCTCAAGCTCCAC | 75 | 5890 | 5909 | 289 |
| 531187 | n/a | n/a | ATCTATTGGTTCAGGAGCCA | 72 | 6015 | 6034 | 290 |
| 531188 | n/a | n/a | GTTAAAACAACTAGAAGCCA | 67 | 6146 | 6165 | 291 |
| 531189 | n/a | n/a | AGGTGTTCTTGCTTATCCTC | 63 | 6484 | 6503 | 292 |
| 531190 | n/a | n/a | GCAGTCACTCCTCTTCCAGC | 59 | 6659 | 6678 | 293 |

TABLE 125-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531191 | n/a | n/a | AAGTGTATTGCCTAGATTTC | 37 | 6784 | 6803 | 294 |
| 531192 | n/a | n/a | GAGTGCCATCTTCTCTGCAC | 61 | 6968 | 6987 | 295 |
| 531193 | n/a | n/a | TTATTCCCAGCTCTAAAATA | 23 | 7274 | 7293 | 296 |
| 531194 | n/a | n/a | CTCACAATTCTGTAAGGGAA | 64 | 7596 | 7615 | 297 |
| 531195 | n/a | n/a | ATAAAATATATTAAGGCAAC | 61 | 7846 | 7865 | 298 |
| 531196 | n/a | n/a | TTGAGTCAGACATCCTGTGA | 38 | 7996 | 8015 | 299 |
| 531197 | n/a | n/a | TACCTTTTCTCCATGTCATT | 42 | 8148 | 8167 | 300 |
| 531198 | n/a | n/a | GGGATTTTGCTGAAGCTGGT | 73 | 8273 | 8292 | 301 |
| 531199 | n/a | n/a | CTTTGAATAGAAAATGACTA | 1 | 8415 | 8434 | 302 |
| 531200 | n/a | n/a | CAAAATCACAAGTTCTAGAT | 51 | 8617 | 8636 | 303 |
| 531201 | n/a | n/a | TTTCCAATACTTTTACAAAT | 52 | 8760 | 8779 | 304 |
| 531202 | n/a | n/a | ATTAATAAGCATCTCTCTGA | 31 | 9109 | 9128 | 305 |
| 531203 | n/a | n/a | TGACTATCCAATTTCTAGTT | 67 | 9253 | 9272 | 306 |
| 531204 | n/a | n/a | CTTGTAGTCTGCACTTAATG | 60 | 9418 | 9437 | 307 |
| 531205 | n/a | n/a | ACATTTTTTAAGTACAGGAA | 0 | 9602 | 9621 | 308 |
| 531206 | n/a | n/a | GAAATGTCTAGCATTTTCTA | 28 | 9755 | 9774 | 309 |
| 531207 | n/a | n/a | CCACTTATTTGATGACCACA | 64 | 9915 | 9934 | 310 |
| 531208 | n/a | n/a | TCCAGAATACTGCCCCATCT | 23 | 10050 | 10069 | 311 |
| 531209 | n/a | n/a | TGGATTCATTTTCTGCAAAT | 81 | 10175 | 10194 | 312 |
| 531210 | n/a | n/a | AGACATTGTCAAATGTCCCC | 60 | 10322 | 10341 | 313 |
| 531211 | n/a | n/a | TTGATGTCAGCACTGTTGAC | 77 | 10480 | 10499 | 314 |
| 531212 | n/a | n/a | ACATCAGTAGCTTCAGATGT | 56 | 10618 | 10637 | 315 |
| 531213 | n/a | n/a | CAAAATTAATTGTGCATAAT | 13 | 10820 | 10839 | 316 |
| 531214 | n/a | n/a | TTTTTCTTTAAATTTTGCTA | 37 | 11120 | 11139 | 317 |
| 531215 | n/a | n/a | TAGAGATTTTATGTACTTGG | 63 | 11245 | 11264 | 318 |
| 531216 | n/a | n/a | AAACACAGGAATTTGCAGAC | 33 | 11408 | 11427 | 319 |
| 531217 | n/a | n/a | GTGGAATAAACCATAATCTA | 47 | 11579 | 11598 | 320 |
| 531218 | n/a | n/a | GATAATTCTTTTCACAGACA | 72 | 12028 | 12047 | 321 |
| 531219 | n/a | n/a | CTTCTCTATCTCCCAGTGTT | 61 | 12227 | 12246 | 322 |
| 531220 | n/a | n/a | CAATACAGGTAAATTTCACG | 56 | 12374 | 12393 | 323 |
| 531221 | n/a | n/a | AAGGGATTTAAAATTTTTAT | 0 | 12507 | 12526 | 324 |
| 531222 | n/a | n/a | GGCAAGCTGTACAAGAAAAA | 19 | 12642 | 12661 | 325 |
| 531223 | n/a | n/a | TGTACTCACCGGTACTCTGC | 58 | 12805 | 12824 | 326 |
| 531224 | n/a | n/a | AAGAGAATGCTCAGAAATGG | 25 | 13435 | 13454 | 327 |
| 531225 | n/a | n/a | ACACTTGTACCCCATACATC | 45 | 13560 | 13579 | 328 |
| 531226 | n/a | n/a | GACAGTAGAGACTGGGAAGG | 12 | 13708 | 13727 | 329 |
| 531227 | n/a | n/a | TACCAATTTCTGAAAGGGCA | 72 | 14224 | 14243 | 330 |

TABLE 125-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531228 | n/a | n/a | CAGAGTAAACTCCCCATCTC | 33 | 14387 | 14406 | 331 |
| 531229 | n/a | n/a | CTTCAAAGCCAGCAGTGTAA | 69 | 14514 | 14533 | 332 |
| 531230 | n/a | n/a | CTTACTGGGCTAAAATCAAG | 46 | 14639 | 14658 | 333 |
| 531231 | n/a | n/a | TATCACTGTACTAGTTTCCT | 94 | 14744 | 14763 | 334 |
|  |  |  |  |  | 14815 | 14834 |  |
|  |  |  |  |  | 14886 | 14905 |  |
|  |  |  |  |  | 14945 | 14964 |  |
|  |  |  |  |  | 15005 | 15024 |  |
|  |  |  |  |  | 15077 | 15096 |  |
|  |  |  |  |  | 15220 | 15239 |  |
|  |  |  |  |  | 15292 | 15311 |  |
|  |  |  |  |  | 15351 | 15370 |  |
|  |  |  |  |  | 15411 | 15430 |  |
|  |  |  |  |  | 15483 | 15502 |  |
|  |  |  |  |  | 15555 | 15574 |  |
|  |  |  |  |  | 15613 | 15632 |  |
|  |  |  |  |  | 15685 | 15704 |  |
|  |  |  |  |  | 15815 | 15834 |  |
|  |  |  |  |  | 15887 | 15906 |  |
|  |  |  |  |  | 15945 | 15964 |  |
| 531232 | n/a | n/a | CTGTACTAGTTTCCTATAAC | 85 | 14739 | 14758 | 335 |
|  |  |  |  |  | 14810 | 14829 |  |
|  |  |  |  |  | 14881 | 14900 |  |
|  |  |  |  |  | 14940 | 14959 |  |
|  |  |  |  |  | 15000 | 15019 |  |
|  |  |  |  |  | 15072 | 15091 |  |
|  |  |  |  |  | 15215 | 15234 |  |
|  |  |  |  |  | 15287 | 15306 |  |
|  |  |  |  |  | 15346 | 15365 |  |
|  |  |  |  |  | 15406 | 15425 |  |
|  |  |  |  |  | 15478 | 15497 |  |
|  |  |  |  |  | 15550 | 15569 |  |
|  |  |  |  |  | 15608 | 15627 |  |
|  |  |  |  |  | 15680 | 15699 |  |
|  |  |  |  |  | 15810 | 15829 |  |
|  |  |  |  |  | 15882 | 15901 |  |
|  |  |  |  |  | 15940 | 15959 |  |
| 531233 | n/a | n/a | ACTGTACTAGTTTCCTATAA | 86 | 14740 | 14759 | 336 |
|  |  |  |  |  | 14811 | 14830 |  |
|  |  |  |  |  | 14882 | 14901 |  |
|  |  |  |  |  | 14941 | 14960 |  |
|  |  |  |  |  | 15001 | 15020 |  |
|  |  |  |  |  | 15073 | 15092 |  |
|  |  |  |  |  | 15216 | 15235 |  |
|  |  |  |  |  | 15288 | 15307 |  |
|  |  |  |  |  | 15347 | 15366 |  |
|  |  |  |  |  | 15407 | 15426 |  |
|  |  |  |  |  | 15479 | 15498 |  |
|  |  |  |  |  | 15551 | 15570 |  |
|  |  |  |  |  | 15609 | 15628 |  |
|  |  |  |  |  | 15681 | 15700 |  |
|  |  |  |  |  | 15811 | 15830 |  |
|  |  |  |  |  | 15883 | 15902 |  |
|  |  |  |  |  | 15941 | 15960 |  |

TABLE 125-continued

| ISIS NO | SEQ ID NO: 1 Start Site | SEQ ID NO: 1 Stop Site | Sequence | % inhibition | SEQ ID NO: 10 Start Site | SEQ ID NO: 10 Stop Site | SEQ ID NO |
|---|---|---|---|---|---|---|---|
| 531234 | n/a | n/a | CACTGTACTAGTTTCCTATA | 86 | 14741 | 14760 | 337 |
|  |  |  |  |  | 14812 | 14831 |  |
|  |  |  |  |  | 14883 | 14902 |  |
|  |  |  |  |  | 14942 | 14960 |  |
|  |  |  |  |  | 15002 | 15021 |  |
|  |  |  |  |  | 15074 | 15093 |  |
|  |  |  |  |  | 15217 | 15236 |  |
|  |  |  |  |  | 15289 | 15308 |  |
|  |  |  |  |  | 15348 | 15367 |  |
|  |  |  |  |  | 15408 | 15427 |  |
|  |  |  |  |  | 15480 | 15499 |  |
|  |  |  |  |  | 15552 | 15571 |  |
|  |  |  |  |  | 15610 | 15627 |  |
|  |  |  |  |  | 15682 | 15701 |  |
|  |  |  |  |  | 15812 | 15831 |  |
|  |  |  |  |  | 15884 | 15903 |  |
|  |  |  |  |  | 15942 | 15961 |  |
| 531235 | n/a | n/a | TCACTGTACTAGTTTCCTAT | 86 | 14742 | 14761 | 338 |
|  |  |  |  |  | 14813 | 14832 |  |
|  |  |  |  |  | 14884 | 14903 |  |
|  |  |  |  |  | 14943 | 14962 |  |
|  |  |  |  |  | 15003 | 15022 |  |
|  |  |  |  |  | 15075 | 15094 |  |
|  |  |  |  |  | 15218 | 15237 |  |
|  |  |  |  |  | 15290 | 15309 |  |
|  |  |  |  |  | 15349 | 15368 |  |
|  |  |  |  |  | 15409 | 15428 |  |
|  |  |  |  |  | 15481 | 15500 |  |
|  |  |  |  |  | 15553 | 15572 |  |
|  |  |  |  |  | 15611 | 15630 |  |
|  |  |  |  |  | 15683 | 15702 |  |
|  |  |  |  |  | 15813 | 15832 |  |
|  |  |  |  |  | 15885 | 15904 |  |
|  |  |  |  |  | 15943 | 15962 |  |
| 531236 | n/a | n/a | ATCACTGTACTAGTTTCCTA | 87 | 14743 | 14762 | 339 |
|  |  |  |  |  | 14814 | 14833 |  |
|  |  |  |  |  | 14885 | 14904 |  |
|  |  |  |  |  | 14944 | 14963 |  |
|  |  |  |  |  | 5004 | 15023 |  |
|  |  |  |  |  | 15076 | 15095 |  |
|  |  |  |  |  | 15219 | 15238 |  |
|  |  |  |  |  | 15291 | 15310 |  |
|  |  |  |  |  | 15350 | 15369 |  |
|  |  |  |  |  | 15410 | 15429 |  |
|  |  |  |  |  | 15482 | 15501 |  |
|  |  |  |  |  | 15554 | 15573 |  |
|  |  |  |  |  | 15612 | 15631 |  |
|  |  |  |  |  | 15684 | 15703 |  |
|  |  |  |  |  | 15814 | 15833 |  |
|  |  |  |  |  | 15886 | 15905 |  |
|  |  |  |  |  | 15944 | 15963 |  |
| 531237 | n/a | n/a | GTGGAATGTCATGGCAATTT | 56 | 16399 | 16418 | 340 |

Example 115

Antisense Inhibition of Human PKK in HepaRG™ Cells by Antisense Oligonucleotides with 2'-MOE Sugar Modifications Additional antisense oligonucleotides were designed targeting a PKK nucleic acid and were tested for their effects on PKK mRNA in vitro.

The chimeric antisense oligonucleotides in the tables below were designed as 5-10-5 MOE gapmers, 4-9-4 MOE gapmers, 4-10-4 MOE gapmers, 4-10-3 MOE gapmers, 3-10-4 MOE gapmers, or 3-10-3 MOE gapmers. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. The 4-9-4 MOE gapmers are 17 nucleosides in length, wherein the central gap segment comprises of nine 2'-deoxynucleosides and is flanked by wing segments on the 5' direction and the 3' direction comprising four nucleosides each. The 4-10-4 MOE gapmers are 18 nucleosides in length, wherein the central gap segment comprises of ten 2'-deoxynucleosides and is flanked by wing segments on the 5' direction and the 3' direction comprising four nucleosides each. The 4-10-3 MOE gapmers are 17 nucleosides in length, wherein the central gap segment comprises of ten 2'-deoxynucleosides and is flanked by wing segments on the 5' direction and the 3' direction comprising four and three nucleosides respectively. The 3-10-4 MOE gapmers are 17 nucleosides in length, wherein the central gap segment comprises of ten 2'-deoxynucleosides and is flanked by wing segments on the 5' direction and the 3' direction comprising three and four nucleosides respectively. The 3-10-3 MOE gapmers are 16 nucleosides in length, wherein the central gap segment comprises of ten 2'-deoxynucleosides and is flanked by wing segments on the 5' direction and the 3' direction comprising three nucleosides each. Each nucleoside in the 5' wing segment and each nucleoside in the 3' wing segment has a 2'-O-methoxyethyl modification. The internucleoside linkages throughout each gapmer are phosphorothioate linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted in the human gene sequence. Each gapmer listed in the tables below is targeted to either SEQ ID NO: 1 or SEQ ID NO: 10. 'n/a' indicates that the antisense oligonucleotide does not target that particular gene sequence.

Cultured HepaRG™ cells at a density of 20,000 cells per well were transfected using electroporation with 5,000 nM antisense oligonucleotide. After a treatment period of approximately 24 hours, RNA was isolated from the cells and PKK mRNA levels were measured by quantitative real-time PCR. Human primer probe set RTS3454 was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells.

TABLE 126

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 98 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |
| 546131 | 4 | 23 | ATGAACGGTCTTCAAGCTGT | 5-10-5 | 75 | 3396 | 3415 | 341 |
| 547269 | 5 | 24 | AATGAACGGTCTTCAAGCTG | 5-10-5 | 56 | 3397 | 3416 | 342 |
| 547270 | 7 | 26 | AAAATGAACGGTCTTCAAGC | 5-10-5 | 68 | 3399 | 3418 | 343 |
| 547271 | 10 | 29 | TTAAAAATGAACGGTCTTCA | 5-10-5 | 60 | 3402 | 3421 | 344 |
| 547272 | 13 | 32 | CACTTAAAAATGAACGGTCT | 5-10-5 | 82 | 3405 | 3424 | 345 |
| 547273 | 25 | 44 | TGAGTCTCTTGTCACTTAAA | 5-10-5 | 93 | 3417 | 3436 | 346 |
| 547274 | 29 | 48 | GAGGTGAGTCTCTTGTCACT | 5-10-5 | 70 | 3421 | 3440 | 347 |
| 546136 | 30 | 49 | GGAGGTGAGTCTCTTGTCAC | 5-10-5 | 86 | 3422 | 3441 | 348 |
| 547275 | 32 | 51 | TTGGAGGTGAGTCTCTTGTC | 5-10-5 | 87 | 3424 | 3443 | 349 |
| 546137 | 40 | 59 | ATTGCTTCTTGGAGGTGAGT | 5-10-5 | 76 | 3432 | 3451 | 350 |
| 547276 | 42 | 61 | CAATTGCTTCTTGGAGGTGA | 5-10-5 | 93 | 3434 | 3453 | 351 |
| 547277 | 44 | 63 | CACAATTGCTTCTTGGAGGT | 5-10-5 | 75 | 3436 | 3455 | 352 |
| 547278 | 45 | 64 | ACACAATTGCTTCTTGGAGG | 5-10-5 | 70 | 3437 | 3456 | 353 |
| 546138 | 47 | 66 | AAACACAATTGCTTCTTGGA | 5-10-5 | 69 | 3439 | 3458 | 354 |
| 547279 | 48 | 67 | AAAACACAATTGCTTCTTGG | 5-10-5 | 69 | 3440 | 3459 | 355 |
| 547280 | 49 | 68 | GAAAACACAATTGCTTCTTG | 5-10-5 | 47 | 3441 | 3460 | 356 |
| 547281 | 70 | 89 | TTGCTTGAATAAAATCATTC | 5-10-5 | 41 | 4069 | 4088 | 357 |

TABLE 126-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546140 | 72 | 91 | GCTTGCTTGAATAAAATCAT | 5-10-5 | 60 | 4071 | 4090 | 358 |
| 547282 | 74 | 93 | TTGCTTGCTTGAATAAAATC | 5-10-5 | 53 | 4073 | 4092 | 359 |
| 547283 | 76 | 95 | AGTTGCTTGCTTGAATAAAA | 5-10-5 | 67 | 4075 | 4094 | 360 |
| 546141 | 82 | 101 | GAAATAAGTTGCTTGCTTGA | 5-10-5 | 56 | 4081 | 4100 | 361 |
| 547284 | 86 | 105 | AAATGAAATAAGTTGCTTGC | 5-10-5 | 26 | 4085 | 4104 | 362 |
| 547285 | 102 | 121 | ACTGTAGCAAACAAGGAAAT | 5-10-5 | 51 | 4101 | 4120 | 363 |
| 546143 | 106 | 125 | GGAAACTGTAGCAAACAAGG | 5-10-5 | 46 | 4105 | 4124 | 364 |
| 546144 | 110 | 129 | CACAGGAAACTGTAGCAAAC | 5-10-5 | 75 | 4109 | 4128 | 365 |
| 547286 | 117 | 136 | AGACATCCACAGGAAACTGT | 5-10-5 | 68 | n/a | n/a | 366 |
| 547287 | 120 | 139 | GTCAGACATCCACAGGAAAC | 5-10-5 | 69 | n/a | n/a | 367 |
| 546146 | 123 | 142 | TGAGTCAGACATCCACAGGA | 5-10-5 | 72 | n/a | n/a | 368 |
| 547288 | 131 | 150 | CATAGAGTTGAGTCAGACAT | 5-10-5 | 80 | 8003 | 8022 | 369 |
| 546147 | 132 | 151 | TCATAGAGTTGAGTCAGACA | 5-10-5 | 76 | 8004 | 8023 | 370 |
| 547289 | 133 | 152 | TTCATAGAGTTGAGTCAGAC | 5-10-5 | 74 | 8005 | 8024 | 371 |
| 546148 | 137 | 156 | CGTTTTCATAGAGTTGAGTC | 5-10-5 | 68 | 8009 | 8028 | 372 |
| 546149 | 155 | 174 | CCCCACCTCTGAAGAAGGCG | 5-10-5 | 83 | 8027 | 8046 | 373 |
| 546150 | 158 | 177 | CATCCCCACCTCTGAAGAAG | 5-10-5 | 58 | 8030 | 8049 | 374 |
| 547290 | 163 | 182 | AGCTACATCCCCACCTCTGA | 5-10-5 | 76 | 8035 | 8054 | 375 |
| 546151 | 166 | 185 | GGAAGCTACATCCCCACCTC | 5-10-5 | 76 | 8038 | 8057 | 376 |
| 547291 | 168 | 187 | ATGGAAGCTACATCCCCACC | 5-10-5 | 74 | 8040 | 8059 | 377 |
| 547292 | 171 | 190 | TACATGGAAGCTACATCCCC | 5-10-5 | 60 | 8043 | 8062 | 378 |
| 546152 | 172 | 191 | GTACATGGAAGCTACATCCC | 5-10-5 | 73 | 8044 | 8063 | 379 |
| 546153 | 176 | 195 | GGGTGTACATGGAAGCTACA | 5-10-5 | 76 | 8048 | 8067 | 380 |
| 546154 | 195 | 214 | TGGCAGTATTGGGCATTTGG | 5-10-5 | 85 | 8067 | 8086 | 381 |
| 547293 | 199 | 218 | CATCTGGCAGTATTGGGCAT | 5-10-5 | 92 | 8071 | 8090 | 382 |
| 547294 | 201 | 220 | CTCATCTGGCAGTATTGGGC | 5-10-5 | 85 | 8073 | 8092 | 383 |
| 546155 | 202 | 221 | CCTCATCTGGCAGTATTGGG | 5-10-5 | 47 | 8074 | 8093 | 384 |
| 547295 | 203 | 222 | ACCTCATCTGGCAGTATTGG | 5-10-5 | 88 | 8075 | 8094 | 385 |
| 547296 | 206 | 225 | TGCACCTCATCTGGCAGTAT | 5-10-5 | 72 | 8078 | 8097 | 386 |
| 546156 | 211 | 230 | GAATGTGCACCTCATCTGGC | 5-10-5 | 81 | 8083 | 8102 | 387 |
| 547297 | 213 | 232 | TGGAATGTGCACCTCATCTG | 5-10-5 | 84 | 8085 | 8104 | 388 |
| 546157 | 216 | 235 | GGGTGGAATGTGCACCTCAT | 5-10-5 | 85 | 8088 | 8107 | 389 |
| 547298 | 218 | 237 | TTGGGTGGAATGTGCACCTC | 5-10-5 | 90 | 8090 | 8109 | 390 |
| 546158 | 219 | 238 | CTTGGGTGGAATGTGCACCT | 5-10-5 | 95 | 8091 | 8110 | 391 |
| 546159 | 229 | 248 | TAGCAAACACCTTGGGTGGA | 5-10-5 | 76 | 8101 | 8120 | 392 |
| 546160 | 235 | 254 | ACTGAATAGCAAACACCTTG | 5-10-5 | 78 | 8107 | 8126 | 393 |
| 547299 | 237 | 256 | AAACTGAATAGCAAACACCT | 5-10-5 | 76 | 8109 | 8128 | 394 |
| 546163 | 250 | 269 | ACTTGCTGGAAGAAAACTGA | 5-10-5 | 42 | 8122 | 8141 | 395 |

TABLE 126-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547300 | 252 | 271 | GAACTTGCTGGAAGAAAACT | 5-10-5 | 37 | 8124 | 8143 | 396 |
| 546164 | 257 | 276 | TGATTGAACTTGCTGGAAGA | 5-10-5 | 33 | 8129 | 8148 | 397 |
| 546165 | 260 | 279 | CATTGATTGAACTTGCTGGA | 5-10-5 | 71 | 8132 | 8151 | 398 |
| 547301 | 261 | 280 | TCATTGATTGAACTTGCTGG | 5-10-5 | 80 | 8133 | 8152 | 399 |
| 546166 | 263 | 282 | TGTCATTGATTGAACTTGCT | 5-10-5 | 70 | 8135 | 8154 | 400 |
| 547302 | 266 | 285 | CCATGTCATTGATTGAACTT | 5-10-5 | 58 | 8138 | 8157 | 401 |
| 546167 | 268 | 287 | CTCCATGTCATTGATTGAAC | 5-10-5 | 73 | 8140 | 8159 | 402 |
| 547303 | 270 | 289 | TTCTCCATGTCATTGATTGA | 5-10-5 | 72 | 8142 | 8161 | 403 |
| 547304 | 273 | 292 | CTTTTCTCCATGTCATTGAT | 5-10-5 | 71 | 8145 | 8164 | 404 |
| 547305 | 280 | 299 | ACCAAACCTTTTCTCCATGT | 5-10-5 | 47 | n/a | n/a | 405 |
| 546170 | 283 | 302 | GCAACCAAACCTTTTCTCCA | 5-10-5 | 54 | n/a | n/a | 406 |
| 547306 | 284 | 303 | AGCAACCAAACCTTTTCTCC | 5-10-5 | 62 | n/a | n/a | 407 |
| 547307 | 286 | 305 | GAAGCAACCAAACCTTTTCT | 5-10-5 | 58 | n/a | n/a | 408 |
| 547308 | 290 | 309 | TCAAGAAGCAACCAAACCTT | 5-10-5 | 66 | n/a | n/a | 409 |
| 547309 | 293 | 312 | CTTTCAAGAAGCAACCAAAC | 5-10-5 | 71 | 9827 | 9846 | 410 |
| 547310 | 295 | 314 | ATCTTTCAAGAAGCAACCAA | 5-10-5 | 81 | 9829 | 9848 | 411 |
| 546171 | 297 | 316 | CTATCTTTCAAGAAGCAACC | 5-10-5 | 81 | 9831 | 9850 | 412 |
| 547311 | 299 | 318 | CACTATCTTTCAAGAAGCAA | 5-10-5 | 71 | 9833 | 9852 | 413 |
| 546172 | 301 | 320 | AACACTATCTTTCAAGAAGC | 5-10-5 | 81 | 9835 | 9854 | 414 |
| 547312 | 325 | 344 | ATGTACTTTTGGCAGGGTTC | 5-10-5 | 46 | 9859 | 9878 | 415 |
| 546173 | 327 | 346 | CGATGTACTTTTGGCAGGGT | 5-10-5 | 84 | 9861 | 9880 | 416 |
| 547313 | 330 | 349 | GTTCGATGTACTTTTGGCAG | 5-10-5 | 73 | 9864 | 9883 | 417 |

TABLE 127

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 86 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 546174 | 333 | 352 | CCTGTTCGATGTACTTTTGG | 5-10-5 | 74 | 9867 | 9886 | 418 |

TABLE 127-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547314 | 336 | 355 | GCACCTGTTCGATGTACTTT | 5-10-5 | 73 | 9870 | 9889 | 419 |
| 546175 | 338 | 357 | CTGCACCTGTTCGATGTACT | 5-10-5 | 78 | 9872 | 9891 | 420 |
| 547315 | 340 | 359 | AACTGCACCTGTTCGATGTA | 5-10-5 | 50 | 9874 | 9893 | 421 |
| 547316 | 342 | 361 | GAAACTGCACCTGTTCGATG | 5-10-5 | 75 | 9876 | 9895 | 422 |
| 547317 | 344 | 363 | CAGAAACTGCACCTGTTCGA | 5-10-5 | 75 | 9878 | 9897 | 423 |
| 547318 | 345 | 364 | CCAGAAACTGCACCTGTTCG | 5-10-5 | 74 | 9879 | 9898 | 424 |
| 546177 | 348 | 367 | TGTCCAGAAACTGCACCTGT | 5-10-5 | 75 | 9882 | 9901 | 425 |
| 547319 | 351 | 370 | GAATGTCCAGAAACTGCACC | 5-10-5 | 62 | 9885 | 9904 | 426 |
| 547320 | 353 | 372 | AGGAATGTCCAGAAACTGCA | 5-10-5 | 73 | 9887 | 9906 | 427 |
| 547321 | 356 | 375 | TCAAGGAATGTCCAGAAACT | 5-10-5 | 53 | 9890 | 9909 | 428 |
| 547322 | 358 | 377 | CTTCAAGGAATGTCCAGAAA | 5-10-5 | 65 | 9892 | 9911 | 429 |
| 547323 | 361 | 380 | TTGCTTCAAGGAATGTCCAG | 5-10-5 | 56 | 9895 | 9914 | 430 |
| 547324 | 363 | 382 | CATTGCTTCAAGGAATGTCC | 5-10-5 | 76 | 9897 | 9916 | 431 |
| 547325 | 368 | 387 | GACCACATTGCTTCAAGGAA | 5-10-5 | 67 | 9902 | 9921 | 432 |
| 546181 | 369 | 388 | TGACCACATTGCTTCAAGGA | 5-10-5 | 75 | 9903 | 9922 | 433 |
| 547326 | 370 | 389 | ATGACCACATTGCTTCAAGG | 5-10-5 | 48 | 9904 | 9923 | 434 |
| 547327 | 373 | 392 | TTGATGACCACATTGCTTCA | 5-10-5 | 45 | 9907 | 9926 | 435 |
| 547328 | 375 | 394 | ATTTGATGACCACATTGCTT | 5-10-5 | 40 | 9909 | 9928 | 436 |
| 547329 | 377 | 396 | TTATTTGATGACCACATTGC | 5-10-5 | 24 | 9911 | 9930 | 437 |
| 547330 | 378 | 397 | CTTATTTGATGACCACATTG | 5-10-5 | 60 | 9912 | 9931 | 438 |
| 546183 | 380 | 399 | CACTTATTTGATGACCACAT | 5-10-5 | 69 | 9914 | 9933 | 439 |
| 547331 | 382 | 401 | AGCACTTATTTGATGACCAC | 5-10-5 | 47 | n/a | n/a | 440 |
| 546184 | 384 | 403 | CAAGCACTTATTTGATGACC | 5-10-5 | 65 | n/a | n/a | 441 |
| 547332 | 390 | 409 | CGATGGCAAGCACTTATTTG | 5-10-5 | 44 | n/a | n/a | 442 |
| 547333 | 395 | 414 | TGTCTCGATGGCAAGCACTT | 5-10-5 | 76 | n/a | n/a | 443 |
| 546186 | 396 | 415 | ATGTCTCGATGGCAAGCACT | 5-10-5 | 84 | n/a | n/a | 444 |
| 547334 | 397 | 416 | AATGTCTCGATGGCAAGCAC | 5-10-5 | 74 | n/a | n/a | 445 |
| 547335 | 402 | 421 | TTATAAATGTCTCGATGGCA | 5-10-5 | 93 | 12658 | 12677 | 446 |
| 547336 | 403 | 422 | TTTATAAATGTCTCGATGGC | 5-10-5 | 81 | 12659 | 12678 | 447 |
| 546188 | 407 | 426 | CTCCTTTATAAATGTCTCGA | 5-10-5 | 95 | 12663 | 12682 | 448 |
| 547337 | 409 | 428 | AACTCCTTTATAAATGTCTC | 5-10-5 | 84 | 12665 | 12684 | 449 |
| 547338 | 411 | 430 | TCAACTCCTTTATAAATGTC | 5-10-5 | 71 | 12667 | 12686 | 450 |
| 547339 | 413 | 432 | TATCAACTCCTTTATAAATG | 5-10-5 | 42 | 12669 | 12688 | 451 |
| 546190 | 419 | 438 | CTCTCATATCAACTCCTTTA | 5-10-5 | 92 | 12675 | 12694 | 452 |
| 547340 | 422 | 441 | CTCCTCTCATATCAACTCCT | 5-10-5 | 93 | 12678 | 12697 | 453 |
| 547341 | 424 | 443 | GACTCCTCTCATATCAACTC | 5-10-5 | 87 | 12680 | 12699 | 454 |
| 546192 | 428 | 447 | AATTGACTCCTCTCATATCA | 5-10-5 | 51 | 12684 | 12703 | 455 |
| 547342 | 433 | 452 | ATTAAAATTGACTCCTCTCA | 5-10-5 | 66 | 12689 | 12708 | 456 |

TABLE 127-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546193 | 434 | 453 | CATTAAAATTGACTCCTCTC | 5-10-5 | 57 | 12690 | 12709 | 457 |
| 547343 | 436 | 455 | CACATTAAAATTGACTCCTC | 5-10-5 | 78 | 12692 | 12711 | 458 |
| 547344 | 438 | 457 | GACACATTAAAATTGACTCC | 5-10-5 | 80 | 12694 | 12713 | 459 |
| 547345 | 439 | 458 | AGACACATTAAAATTGACTC | 5-10-5 | 80 | 12695 | 12714 | 460 |
| 547346 | 444 | 463 | ACCTTAGACACATTAAAATT | 5-10-5 | 57 | 12700 | 12719 | 461 |
| 546195 | 448 | 467 | GCTAACCTTAGACACATTAA | 5-10-5 | 83 | 12704 | 12723 | 462 |
| 547347 | 451 | 470 | ACTGCTAACCTTAGACACAT | 5-10-5 | 82 | 12707 | 12726 | 463 |
| 546196 | 452 | 471 | CACTGCTAACCTTAGACACA | 5-10-5 | 83 | 12708 | 12727 | 464 |
| 547348 | 453 | 472 | ACACTGCTAACCTTAGACAC | 5-10-5 | 83 | 12709 | 12728 | 465 |
| 547349 | 458 | 477 | CTTCAACACTGCTAACCTTA | 5-10-5 | 88 | 12714 | 12733 | 466 |
| 546198 | 459 | 478 | TCTTCAACACTGCTAACCTT | 5-10-5 | 85 | 12715 | 12734 | 467 |
| 547350 | 464 | 483 | GGCATTCTTCAACACTGCTA | 5-10-5 | 96 | 12720 | 12739 | 468 |
| 546199 | 465 | 484 | TGGCATTCTTCAACACTGCT | 5-10-5 | 97 | 12721 | 12740 | 469 |
| 547351 | 467 | 486 | TTTGGCATTCTTCAACACTG | 5-10-5 | 92 | 12723 | 12742 | 470 |
| 546200 | 500 | 519 | AAAACTGGCAGCGAATGTTA | 5-10-5 | 91 | 12756 | 12775 | 471 |
| 547352 | 541 | 560 | CCGGTACTCTGCCTTGTGAA | 5-10-5 | 94 | 12797 | 12816 | 472 |
| 547354 | 547 | 566 | ATTGTTCCGGTACTCTGCCT | 5-10-5 | 89 | n/a | n/a | 473 |
| 546203 | 548 | 567 | AATTGTTCCGGTACTCTGCC | 5-10-5 | 76 | n/a | n/a | 474 |
| 547355 | 549 | 568 | CAATTGTTCCGGTACTCTGC | 5-10-5 | 77 | n/a | n/a | 475 |
| 546204 | 555 | 574 | AATAGGCAATTGTTCCGGTA | 5-10-5 | 91 | n/a | n/a | 476 |
| 547356 | 556 | 575 | TAATAGGCAATTGTTCCGGT | 5-10-5 | 83 | n/a | n/a | 477 |
| 547357 | 559 | 578 | CTTTAATAGGCAATTGTTCC | 5-10-5 | 78 | 14130 | 14149 | 478 |
| 546205 | 562 | 581 | GTACTTTAATAGGCAATTGT | 5-10-5 | 83 | 14133 | 14152 | 479 |
| 547359 | 569 | 588 | CGGGACTGTACTTTAATAGG | 5-10-5 | 81 | 14140 | 14159 | 480 |
| 546208 | 605 | 624 | CGTTACTCAGCACCTTTATA | 5-10-5 | 92 | 14176 | 14195 | 481 |
| 546209 | 629 | 648 | GCTTCAGTGAGAATCCAGAT | 5-10-5 | 73 | 14200 | 14219 | 482 |
| 546210 | 651 | 670 | CCAATTTCTGAAAGGGCACA | 5-10-5 | 79 | 14222 | 14241 | 483 |
| 547360 | 653 | 672 | AACCAATTTCTGAAAGGGCA | 5-10-5 | 88 | n/a | n/a | 484 |
| 547361 | 655 | 674 | GCAACCAATTTCTGAAAGGG | 5-10-5 | 46 | n/a | n/a | 485 |
| 546211 | 656 | 675 | GGCAACCAATTTCTGAAAGG | 5-10-5 | 42 | n/a | n/a | 486 |
| 546212 | 678 | 697 | AGATGCTGGAAGATGTTCAT | 5-10-5 | 48 | 26126 | 26145 | 487 |
| 547362 | 701 | 720 | CAACATCCACATCTGAGAAC | 5-10-5 | 47 | 26149 | 26168 | 488 |
| 547363 | 703 | 722 | GGCAACATCCACATCTGAGA | 5-10-5 | 84 | 26151 | 26170 | 489 |
| 546213 | 707 | 726 | CCCTGGCAACATCCACATCT | 5-10-5 | 82 | 26155 | 26174 | 490 |

TABLE 128

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 88 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15571 15632 15704 15834 15906 15964 | 334 |
| 547364 | 710 | 729 | GAACCCTGGCAACATCCACA | 5-10-5 | 92 | 26158 | 26177 | 491 |
| 546214 | 712 | 731 | GAGAACCCTGGCAACATCCA | 5-10-5 | 88 | 26160 | 26179 | 492 |
| 547365 | 713 | 732 | TGAGAACCCTGGCAACATCC | 5-10-5 | 81 | 26161 | 26180 | 493 |
| 547366 | 717 | 736 | GGAGTGAGAACCCTGGCAAC | 5-10-5 | 86 | 26165 | 26184 | 494 |
| 546216 | 719 | 738 | CTGGAGTGAGAACCCTGGCA | 5-10-5 | 93 | 26167 | 26186 | 495 |
| 547367 | 721 | 740 | ATCTGGAGTGAGAACCCTGG | 5-10-5 | 76 | 26169 | 26188 | 496 |
| 547368 | 723 | 742 | GCATCTGGAGTGAGAACCCT | 5-10-5 | 89 | 26171 | 26190 | 497 |
| 547369 | 725 | 744 | AAGCATCTGGAGTGAGAACC | 5-10-5 | 76 | 26173 | 26192 | 498 |
| 547370 | 728 | 747 | CAAAAGCATCTGGAGTGAGA | 5-10-5 | 73 | 26176 | 26195 | 499 |
| 546217 | 730 | 749 | CACAAAAGCATCTGGAGTGA | 5-10-5 | 83 | 26178 | 26197 | 500 |
| 546218 | 740 | 759 | TGGTCCGACACACAAAAGCA | 5-10-5 | 71 | 26188 | 26207 | 501 |
| 547371 | 741 | 760 | ATGGTCCGACACACAAAAGC | 5-10-5 | 66 | 26189 | 26208 | 502 |
| 547372 | 742 | 761 | GATGGTCCGACACACAAAAG | 5-10-5 | 32 | 26190 | 26209 | 503 |
| 547373 | 745 | 764 | GCAGATGGTCCGACACACAA | 5-10-5 | 90 | 26193 | 26212 | 504 |
| 546220 | 750 | 769 | TAGGTGCAGATGGTCCGACA | 5-10-5 | 71 | 26198 | 26217 | 505 |
| 547374 | 752 | 771 | GATAGGTGCAGATGGTCCGA | 5-10-5 | 81 | 26200 | 26219 | 506 |
| 547375 | 754 | 773 | GTGATAGGTGCAGATGGTCC | 5-10-5 | 72 | 26202 | 26221 | 507 |
| 546222 | 756 | 775 | GGGTGATAGGTGCAGATGGT | 5-10-5 | 12 | 26204 | 26223 | 508 |
| 547376 | 778 | 797 | GAATGTAAAGAAGAGGCAGT | 5-10-5 | 43 | 26226 | 26245 | 509 |
| 546224 | 780 | 799 | TAGAATGTAAAGAAGAGGCA | 5-10-5 | 65 | 26228 | 26247 | 510 |
| 547377 | 788 | 807 | CATTTGTATAGAATGTAAAG | 5-10-5 | 6 | 26236 | 26255 | 511 |
| 547378 | 790 | 809 | TACATTTGTATAGAATGTAA | 5-10-5 | 0 | 26238 | 26257 | 512 |
| 546226 | 793 | 812 | CCATACATTTGTATAGAATG | 5-10-5 | 37 | 26241 | 26260 | 513 |
| 547379 | 802 | 821 | CTCGATTTTCCATACATTTG | 5-10-5 | 37 | 26250 | 26269 | 514 |
| 547380 | 805 | 824 | TGACTCGATTTTCCATACAT | 5-10-5 | 42 | 26253 | 26272 | 515 |
| 546228 | 806 | 825 | GTGACTCGATTTTCCATACA | 5-10-5 | 60 | 26254 | 26273 | 516 |
| 547381 | 807 | 826 | TGTGACTCGATTTTCCATAC | 5-10-5 | 49 | 26255 | 26274 | 517 |
| 547382 | 810 | 829 | CTTTGTGACTCGATTTTCCA | 5-10-5 | 62 | 26258 | 26277 | 518 |
| 547383 | 812 | 831 | TTCTTTGTGACTCGATTTTC | 5-10-5 | 37 | n/a | n/a | 519 |

TABLE 128-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546229 | 816 | 835 | ACATTTCTTTGTGACTCGAT | 5-10-5 | 19 | n/a | n/a | 520 |
| 547384 | 818 | 837 | AAACATTTCTTTGTGACTCG | 5-10-5 | 50 | n/a | n/a | 521 |
| 547385 | 847 | 866 | TGTGCCACTTTCAGATGTTT | 5-10-5 | 80 | 27111 | 27130 | 522 |
| 546230 | 848 | 867 | GTGTGCCACTTTCAGATGTT | 5-10-5 | 70 | 27112 | 27131 | 523 |
| 546231 | 852 | 871 | CTTGGTGTGCCACTTTCAGA | 5-10-5 | 79 | 27116 | 27135 | 524 |
| 547386 | 853 | 872 | ACTTGGTGTGCCACTTTCAG | 5-10-5 | 78 | 27117 | 27136 | 525 |
| 546232 | 857 | 876 | AGGAACTTGGTGTGCCACTT | 5-10-5 | 86 | 27121 | 27140 | 526 |
| 547387 | 878 | 897 | TGGTGTTTTCTTGAGGAGTA | 5-10-5 | 73 | 27142 | 27161 | 527 |
| 546233 | 879 | 898 | ATGGTGTTTTCTTGAGGAGT | 5-10-5 | 69 | 27143 | 27162 | 528 |
| 547388 | 880 | 899 | TATGGTGTTTTCTTGAGGAG | 5-10-5 | 55 | 27144 | 27163 | 529 |
| 547389 | 884 | 903 | CAGATATGGTGTTTTCTTGA | 5-10-5 | 61 | 27148 | 27167 | 530 |
| 546234 | 885 | 904 | CCAGATATGGTGTTTTCTTG | 5-10-5 | 69 | 27149 | 27168 | 531 |
| 547390 | 887 | 906 | ATCCAGATATGGTGTTTTCT | 5-10-5 | 63 | 27151 | 27170 | 532 |
| 547391 | 889 | 908 | ATATCCAGATATGGTGTTTT | 5-10-5 | 32 | 27153 | 27172 | 533 |
| 546235 | 893 | 912 | GGCTATATCCAGATATGGTG | 5-10-5 | 77 | 27157 | 27176 | 534 |
| 547392 | 895 | 914 | AAGGCTATATCCAGATATGG | 5-10-5 | 81 | 27159 | 27178 | 535 |
| 546236 | 900 | 919 | GTTAAAAGGCTATATCCAGA | 5-10-5 | 50 | 27164 | 27183 | 536 |
| 546237 | 903 | 922 | CAGGTTAAAAGGCTATATCC | 5-10-5 | 64 | 27167 | 27186 | 537 |
| 547393 | 905 | 924 | TGCAGGTTAAAAGGCTATAT | 5-10-5 | 73 | 27169 | 27188 | 538 |
| 547394 | 907 | 926 | TTTGCAGGTTAAAAGGCTAT | 5-10-5 | 29 | 27171 | 27190 | 539 |
| 546238 | 909 | 928 | CTTTTGCAGGTTAAAAGGCT | 5-10-5 | 63 | 27173 | 27192 | 540 |
| 546239 | 912 | 931 | GTTCTTTTGCAGGTTAAAAG | 5-10-5 | 47 | 27176 | 27195 | 541 |
| 547395 | 914 | 933 | AAGTTCTTTTGCAGGTTAAA | 5-10-5 | 15 | 27178 | 27197 | 542 |
| 546240 | 917 | 936 | GTAAAGTTCTTTTGCAGGTT | 5-10-5 | 23 | 27181 | 27200 | 543 |
| 546241 | 920 | 939 | CAGGTAAAGTTCTTTTGCAG | 5-10-5 | 69 | 27184 | 27203 | 544 |
| 547396 | 921 | 940 | TCAGGTAAAGTTCTTTTGCA | 5-10-5 | 49 | n/a | n/a | 545 |
| 547397 | 923 | 942 | GTTCAGGTAAAGTTCTTTTG | 5-10-5 | 27 | n/a | n/a | 546 |
| 546242 | 925 | 944 | GGGTTCAGGTAAAGTTCTTT | 5-10-5 | 8 | n/a | n/a | 547 |
| 547398 | 927 | 946 | CAGGGTTCAGGTAAAGTTCT | 5-10-5 | 16 | n/a | n/a | 548 |
| 547399 | 928 | 947 | GCAGGGTTCAGGTAAAGTTC | 5-10-5 | 10 | n/a | n/a | 549 |
| 547400 | 930 | 949 | TGGCAGGGTTCAGGTAAAGT | 5-10-5 | 0 | n/a | n/a | 550 |
| 547401 | 933 | 952 | GAATGGCAGGGTTCAGGTAA | 5-10-5 | 22 | n/a | n/a | 551 |
| 546243 | 934 | 953 | AGAATGGCAGGGTTCAGGTA | 5-10-5 | 16 | n/a | n/a | 552 |
| 547402 | 937 | 956 | TTTAGAATGGCAGGGTTCAG | 5-10-5 | 59 | n/a | n/a | 553 |
| 547403 | 939 | 958 | ATTTTAGAATGGCAGGGTTC | 5-10-5 | 10 | 27361 | 27380 | 554 |
| 546244 | 942 | 961 | TAAATTTTAGAATGGCAGGG | 5-10-5 | 27 | 27364 | 27383 | 555 |
| 547404 | 956 | 975 | AGTCAACTCCCGGGTAAATT | 5-10-5 | 64 | 27378 | 27397 | 556 |

TABLE 128-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547405 | 959 | 978 | CAAAGTCAACTCCCGGGTAA | 5-10-5 | 47 | 27381 | 27400 | 557 |
| 546247 | 960 | 979 | CCAAAGTCAACTCCCGGGTA | 5-10-5 | 90 | 27382 | 27401 | 558 |
| 546248 | 963 | 982 | CCTCCAAAGTCAACTCCCGG | 5-10-5 | 86 | 27385 | 27404 | 559 |
| 547406 | 965 | 984 | CTCCTCCAAAGTCAACTCCC | 5-10-5 | 81 | 27387 | 27406 | 560 |
| 546249 | 968 | 987 | CTTCTCCTCCAAAGTCAACT | 5-10-5 | 68 | 27390 | 27409 | 561 |
| 547407 | 975 | 994 | TTCAATTCTTCTCCTCCAAA | 5-10-5 | 59 | 27397 | 27416 | 562 |
| 546250 | 977 | 996 | CATTCAATTCTTCTCCTCCA | 5-10-5 | 65 | 27399 | 27418 | 563 |
| 547408 | 980 | 999 | TCACATTCAATTCTTCTCCT | 5-10-5 | 84 | 27402 | 27421 | 564 |
| 547409 | 982 | 1001 | AGTCACATTCAATTCTTCTC | 5-10-5 | 67 | 27404 | 27423 | 565 |
| 546251 | 1007 | 1026 | GGCAAACATTCACTCCTTTA | 5-10-5 | 92 | 27429 | 27448 | 566 |

TABLE 129

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 95 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 344 |
| 546252 | 1011 | 1030 | TCTTGGCAAACATTCACTCC | 5-10-5 | 73 | 27433 | 27452 | 567 |
| 546253 | 1014 | 1033 | GTCTCTTGGCAAACATTCAC | 5-10-5 | 98 | 27436 | 27455 | 568 |
| 547410 | 1017 | 1036 | CAAGTCTCTTGGCAAACATT | 5-10-5 | 88 | 27439 | 27458 | 569 |
| 546254 | 1019 | 1038 | TGCAAGTCTCTTGGCAAACA | 5-10-5 | 95 | 27441 | 27460 | 570 |
| 546255 | 1024 | 1043 | CTTTGTGCAAGTCTCTTGGC | 5-10-5 | 92 | 27446 | 27465 | 571 |
| 547411 | 1027 | 1046 | CATCTTTGTGCAAGTCTCTT | 5-10-5 | 79 | 27449 | 27468 | 572 |
| 546256 | 1028 | 1047 | TCATCTTTGTGCAAGTCTCT | 5-10-5 | 83 | 27450 | 27469 | 573 |
| 547412 | 1029 | 1048 | ATCATCTTTGTGCAAGTCTC | 5-10-5 | 73 | 27451 | 27470 | 574 |
| 546258 | 1036 | 1055 | ACAGCGAATCATCTTTGTGC | 5-10-5 | 74 | 27458 | 27477 | 575 |
| 546259 | 1040 | 1059 | ACTGACAGCGAATCATCTTT | 5-10-5 | 86 | 27462 | 27481 | 576 |
| 546260 | 1045 | 1064 | GAAAAACTGACAGCGAATCA | 5-10-5 | 84 | 27467 | 27486 | 577 |
| 547413 | 1047 | 1066 | GTGAAAAACTGACAGCGAAT | 5-10-5 | 94 | 27469 | 27488 | 578 |
| 546263 | 1061 | 1080 | GGAGTAAAGAATAAGTGAAA | 5-10-5 | 0 | 27483 | 27502 | 579 |
| 547414 | 1063 | 1082 | TGGGAGTAAAGAATAAGTGA | 5-10-5 | 76 | 27485 | 27504 | 580 |

TABLE 129-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547415 | 1065 | 1084 | TCTGGGAGTAAAGAATAAGT | 5-10-5 | 71 | 27487 | 27506 | 581 |
| 546265 | 1069 | 1088 | GTCTTCTGGGAGTAAAGAAT | 5-10-5 | 65 | 27491 | 27510 | 582 |
| 546266 | 1072 | 1091 | ACAGTCTTCTGGGAGTAAAG | 5-10-5 | 63 | 27494 | 27513 | 583 |
| 547416 | 1075 | 1094 | CTTACAGTCTTCTGGGAGTA | 5-10-5 | 79 | 27497 | 27516 | 584 |
| 546267 | 1076 | 1095 | CCTTACAGTCTTCTGGGAGT | 5-10-5 | 72 | 27498 | 27517 | 585 |
| 547417 | 1077 | 1096 | TCCTTACAGTCTTCTGGGAG | 5-10-5 | 68 | 27499 | 27518 | 586 |
| 546268 | 1079 | 1098 | CTTCCTTACAGTCTTCTGGG | 5-10-5 | 93 | 27501 | 27520 | 587 |
| 547418 | 1092 | 1111 | CACTTACACTTCTCTTCCTT | 5-10-5 | 0 | n/a | n/a | 588 |
| 546270 | 1093 | 1112 | ACACTTACACTTCTCTTCCT | 5-10-5 | 32 | n/a | n/a | 589 |
| 546271 | 1097 | 1116 | AGAAACACTTACACTTCTCT | 5-10-5 | 60 | n/a | n/a | 590 |
| 547419 | 1101 | 1120 | CTTAAGAAACACTTACACTT | 5-10-5 | 51 | n/a | n/a | 591 |
| 547420 | 1112 | 1131 | CCATAGATAATCTTAAGAAA | 5-10-5 | 8 | 27633 | 27652 | 592 |
| 547421 | 1115 | 1134 | CATCCATAGATAATCTTAAG | 5-10-5 | 69 | 27636 | 27655 | 593 |
| 547422 | 1117 | 1136 | ACCATCCATAGATAATCTTA | 5-10-5 | 70 | 27638 | 27657 | 594 |
| 546275 | 1119 | 1138 | GAACCATCCATAGATAATCT | 5-10-5 | 87 | 27640 | 27659 | 595 |
| 546276 | 1123 | 1142 | TGGAGAACCATCCATAGATA | 5-10-5 | 74 | 27644 | 27663 | 596 |
| 546277 | 1146 | 1165 | TGTGTCCCATACGCAATCCT | 5-10-5 | 90 | 27667 | 27686 | 597 |
| 547423 | 1150 | 1169 | CCCTTGTGTCCCATACGCAA | 5-10-5 | 95 | 27671 | 27690 | 598 |
| 546279 | 1153 | 1172 | GCTCCCTTGTGTCCCATACG | 5-10-5 | 82 | 27674 | 27693 | 599 |
| 547424 | 1156 | 1175 | AGAGCTCCCTTGTGTCCCAT | 5-10-5 | 90 | 27677 | 27696 | 600 |
| 546280 | 1158 | 1177 | CCAGAGCTCCCTTGTGTCCC | 5-10-5 | 86 | 27679 | 27698 | 601 |
| 547425 | 1161 | 1180 | TAACCAGAGCTCCCTTGTGT | 5-10-5 | 85 | 27682 | 27701 | 602 |
| 546281 | 1162 | 1181 | GTAACCAGAGCTCCCTTGTG | 5-10-5 | 85 | 27683 | 27702 | 603 |
| 547426 | 1164 | 1183 | GAGTAACCAGAGCTCCCTTG | 5-10-5 | 92 | 27685 | 27704 | 604 |
| 547427 | 1166 | 1185 | AAGAGTAACCAGAGCTCCCT | 5-10-5 | 79 | 27687 | 27706 | 605 |
| 547428 | 1169 | 1188 | TCAAAGAGTAACCAGAGCTC | 5-10-5 | 78 | 27690 | 27709 | 606 |
| 546283 | 1171 | 1190 | TCTCAAAGAGTAACCAGAGC | 5-10-5 | 88 | 27692 | 27711 | 607 |
| 547429 | 1173 | 1192 | AATCTCAAAGAGTAACCAGA | 5-10-5 | 81 | 27694 | 27713 | 608 |
| 547430 | 1174 | 1193 | CAATCTCAAAGAGTAACCAG | 5-10-5 | 70 | 27695 | 27714 | 609 |
| 546284 | 1176 | 1195 | CACAATCTCAAAGAGTAACC | 5-10-5 | 89 | 27697 | 27716 | 610 |
| 546285 | 1180 | 1199 | GTTACACAATCTCAAAGAGT | 5-10-5 | 76 | 27701 | 27720 | 611 |
| 547431 | 1184 | 1203 | CAGTGTTACACAATCTCAAA | 5-10-5 | 67 | 27705 | 27724 | 612 |
| 547432 | 1186 | 1205 | CCCAGTGTTACACAATCTCA | 5-10-5 | 90 | 27707 | 27726 | 613 |
| 547433 | 1189 | 1208 | GTCCCAGTGTTACACAATC | 5-10-5 | 63 | 27710 | 27729 | 614 |
| 546287 | 1192 | 1211 | GTTGTCCCAGTGTTACACA | 5-10-5 | 82 | 27713 | 27732 | 615 |
| 546288 | 1240 | 1259 | GTTTGTTCCTCCAACAATGC | 5-10-5 | 78 | 27916 | 27935 | 616 |
| 547434 | 1243 | 1262 | AGAGTTTGTTCCTCCAACAA | 5-10-5 | 54 | 27919 | 27938 | 617 |

TABLE 129-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547435 | 1248 | 1267 | CAAGAAGAGTTTGTTCCTCC | 5-10-5 | 85 | 27924 | 27943 | 618 |
| 546290 | 1251 | 1270 | CCCCAAGAAGAGTTTGTTCC | 5-10-5 | 86 | 27927 | 27946 | 619 |
| 547436 | 1253 | 1272 | CTCCCCAAGAAGAGTTTGTT | 5-10-5 | 0 | 27929 | 27948 | 620 |
| 547437 | 1255 | 1274 | CTCTCCCCAAGAAGAGTTTG | 5-10-5 | 50 | 27931 | 27950 | 621 |
| 547438 | 1261 | 1280 | GGGCCACTCTCCCCAAGAAG | 5-10-5 | 82 | 27937 | 27956 | 622 |
| 546291 | 1263 | 1282 | CAGGGCCACTCTCCCCAAGA | 5-10-5 | 81 | 27939 | 27958 | 623 |
| 547439 | 1298 | 1317 | TCTGAGCTGTCAGCTTCACC | 5-10-5 | 85 | 27974 | 27993 | 624 |
| 546293 | 1301 | 1320 | GCCTCTGAGCTGTCAGCTTC | 5-10-5 | 64 | 27977 | 27996 | 625 |
| 547440 | 1327 | 1346 | TCCTATGAGTGACCCTCCAC | 5-10-5 | 67 | 28003 | 28022 | 626 |
| 546294 | 1328 | 1347 | GTCCTATGAGTGACCCTCCA | 5-10-5 | 72 | 28004 | 28023 | 627 |
| 547441 | 1331 | 1350 | GGTGTCCTATGAGTGACCCT | 5-10-5 | 62 | 28007 | 28026 | 628 |
| 547442 | 1332 | 1351 | TGGTGTCCTATGAGTGACCC | 5-10-5 | 42 | 28008 | 28027 | 629 |
| 547443 | 1336 | 1355 | CCACTGGTGTCCTATGAGTG | 5-10-5 | 70 | 28012 | 28031 | 630 |
| 546295 | 1337 | 1356 | CCCACTGGTGTCCTATGAGT | 5-10-5 | 67 | 28013 | 28032 | 631 |
| 546296 | 1370 | 1389 | GAAGCCCATCAAAGCAGTGG | 5-10-5 | 27 | n/a | n/a | 632 |
| 546297 | 1397 | 1416 | TATAGATGCGCCAAACATCC | 5-10-5 | 82 | 30475 | 30494 | 633 |
| 547444 | 1398 | 1417 | CTATAGATGCGCCAAACATC | 5-10-5 | 71 | 30476 | 30495 | 634 |
| 547445 | 1402 | 1421 | GCCACTATAGATGCGCCAAA | 5-10-5 | 97 | 30480 | 30499 | 635 |
| 546299 | 1404 | 1423 | ATGCCACTATAGATGCGCCA | 5-10-5 | 84 | 30482 | 30501 | 636 |
| 546300 | 1424 | 1443 | TAATGTCTGACAGATTTAAA | 5-10-5 | 58 | 30502 | 30521 | 637 |
| 546301 | 1427 | 1446 | TTGTAATGTCTGACAGATTT | 5-10-5 | 93 | 30505 | 30524 | 638 |
| 546302 | 1444 | 1463 | TGAGAAGGTGTATCTTTTG | 5-10-5 | 87 | 30522 | 30541 | 639 |
| 547446 | 1447 | 1466 | TTGTGAGAAAGGTGTATCTT | 5-10-5 | 84 | 30525 | 30544 | 640 |
| 546303 | 1448 | 1467 | TTTGTGAGAAAGGTGTATCT | 5-10-5 | 77 | 30526 | 30545 | 641 |
| 547447 | 1449 | 1468 | ATTTGTGAGAAAGGTGTATC | 5-10-5 | 80 | 30527 | 30546 | 642 |

TABLE 130

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 531231 | n/a | n/a | TATCACTGTACTAGTTTCCT | 5-10-5 | 96 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |

TABLE 130-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| | | | | | | 15685 | 15704 | |
| | | | | | | 15815 | 15834 | |
| | | | | | | 15887 | 15906 | |
| | | | | | | 15945 | 15964 | |
| 547448 | 1451 | 1470 | TTATTTGTGAGAAAGGTGTA | 5-10-5 | 75 | 30529 | 30548 | 643 |
| 547449 | 1453 | 1472 | TTTTATTTGTGAGAAAGGTG | 5-10-5 | 71 | 30531 | 30550 | 644 |
| 546304 | 1454 | 1473 | CTTTTATTTGTGAGAAAGGT | 5-10-5 | 94 | 30532 | 30551 | 645 |
| 547450 | 1456 | 1475 | CTCTTTTATTTGTGAGAAAG | 5-10-5 | 71 | 30534 | 30553 | 646 |
| 547451 | 1471 | 1490 | TTGGTGAATAATAATCTCTT | 5-10-5 | 75 | 30549 | 30568 | 647 |
| 546306 | 1472 | 1491 | TTTGGTGAATAATAATCTCT | 5-10-5 | 65 | 30550 | 30569 | 648 |
| 547452 | 1474 | 1493 | GTTTTGGTGAATAATAATCT | 5-10-5 | 47 | 30552 | 30571 | 649 |
| 546307 | 1478 | 1497 | TATAGTTTTGGTGAATAATA | 5-10-5 | 12 | 30556 | 30575 | 650 |
| 546308 | 1482 | 1501 | ACTTTATAGTTTTGGTGAAT | 5-10-5 | 57 | 30560 | 30579 | 651 |
| 546309 | 1492 | 1511 | CCCTTCTGAGACTTTATAGT | 5-10-5 | 88 | 30570 | 30589 | 652 |
| 546310 | 1496 | 1515 | GATTCCCTTCTGAGACTTTA | 5-10-5 | 78 | 30574 | 30593 | 653 |
| 546311 | 1499 | 1518 | CATGATTCCCTTCTGAGACT | 5-10-5 | 79 | 30577 | 30596 | 654 |
| 547453 | 1500 | 1519 | TCATGATTCCCTTCTGAGAC | 5-10-5 | 81 | 30578 | 30597 | 655 |
| 547454 | 1502 | 1521 | TATCATGATTCCCTTCTGAG | 5-10-5 | 92 | 30580 | 30599 | 656 |
| 547455 | 1503 | 1522 | ATATCATGATTCCCTTCTGA | 5-10-5 | 88 | 30581 | 30600 | 657 |
| 547456 | 1506 | 1525 | GCATATCATGATTCCCTTC | 5-10-5 | 89 | 30584 | 30603 | 658 |
| 546313 | 1507 | 1526 | GGCGATATCATGATTCCCTT | 5-10-5 | 60 | 30585 | 30604 | 659 |
| 547457 | 1509 | 1528 | AAGGCGATATCATGATTCCC | 5-10-5 | 89 | 30587 | 30606 | 660 |
| 547458 | 1513 | 1532 | TATCAAGGCGATATCATGAT | 5-10-5 | 84 | 30591 | 30610 | 661 |
| 547459 | 1519 | 1538 | GAGTTTTATCAAGGCGATAT | 5-10-5 | 28 | 30597 | 30616 | 662 |
| 547460 | 1522 | 1541 | CTGGAGTTTTATCAAGGCGA | 5-10-5 | 72 | 30600 | 30619 | 663 |
| 546316 | 1524 | 1543 | GCCTGGAGTTTTATCAAGGC | 5-10-5 | 51 | 30602 | 30621 | 664 |
| 546317 | 1528 | 1547 | AGGAGCCTGGAGTTTTATCA | 5-10-5 | 12 | 30606 | 30625 | 665 |
| 546318 | 1534 | 1553 | ATTCAAAGGAGCCTGGAGTT | 5-10-5 | 47 | 30612 | 30631 | 666 |
| 547461 | 1537 | 1556 | GTAATTCAAAGGAGCCTGGA | 5-10-5 | 49 | 30615 | 30634 | 667 |
| 547462 | 1539 | 1558 | GTGTAATTCAAAGGAGCCTG | 5-10-5 | 59 | 30617 | 30636 | 668 |
| 546319 | 1541 | 1560 | CAGTGTAATTCAAAGGAGCC | 5-10-5 | 50 | 30619 | 30638 | 669 |
| 547463 | 1564 | 1583 | TAGGCATATTGGTTTTGGA | 5-10-5 | 74 | 31870 | 31889 | 670 |
| 546320 | 1566 | 1585 | GGTAGGCATATTGGTTTTG | 5-10-5 | 72 | 31872 | 31891 | 671 |
| 546321 | 1569 | 1588 | GAAGGTAGGCATATTGGTTT | 5-10-5 | 53 | 31875 | 31894 | 672 |
| 546322 | 1584 | 1603 | CTTGTGTCACCTTTGGAAGG | 5-10-5 | 74 | 31890 | 31909 | 673 |
| 547464 | 1585 | 1604 | GCTTGTGTCACCTTTGGAAG | 5-10-5 | 95 | 31891 | 31910 | 674 |
| 546323 | 1587 | 1606 | GTGCTTGTGTCACCTTTGGA | 5-10-5 | 94 | 31893 | 31912 | 675 |
| 547465 | 1592 | 1611 | AAATTGTGCTTGTGTCACCT | 5-10-5 | 88 | 31898 | 31917 | 676 |

TABLE 130-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 547466 | 1596 | 1615 | GTATAAATTGTGCTTGTGTC | 5-10-5 | 82 | 31902 | 31921 | 677 |
| 546324 | 1597 | 1616 | GGTATAAATTGTGCTTGTGT | 5-10-5 | 73 | 31903 | 31922 | 678 |
| 547467 | 1598 | 1617 | TGGTATAAATTGTGCTTGTG | 5-10-5 | 80 | 31904 | 31923 | 679 |
| 547468 | 1600 | 1619 | GTTGGTATAAATTGTGCTTG | 5-10-5 | 61 | 31906 | 31925 | 680 |
| 546325 | 1602 | 1621 | CAGTTGGTATAAATTGTGCT | 5-10-5 | 74 | 31908 | 31927 | 681 |
| 546326 | 1607 | 1626 | CCCAACAGTTGGTATAAATT | 5-10-5 | 62 | 31913 | 31932 | 682 |
| 547469 | 1610 | 1629 | TTACCCAACAGTTGGTATAA | 5-10-5 | 67 | 31916 | 31935 | 683 |
| 546327 | 1612 | 1631 | GGTTACCCAACAGTTGGTAT | 5-10-5 | 95 | 31918 | 31937 | 684 |
| 546328 | 1624 | 1643 | GAAGCCCCATCCGGTTACCC | 5-10-5 | 84 | 31930 | 31949 | 685 |
| 547470 | 1628 | 1647 | TCGAGAAGCCCCATCCGGTT | 5-10-5 | 70 | 31934 | 31953 | 686 |
| 546329 | 1631 | 1650 | CCTTCGAGAAGCCCCATCCG | 5-10-5 | 18 | 31937 | 31956 | 687 |
| 546330 | 1636 | 1655 | TTTCTCCTTCGAGAAGCCCC | 5-10-5 | 55 | 31942 | 31961 | 688 |
| 547471 | 1638 | 1657 | CCTTTCTCCTTCGAGAAGCC | 5-10-5 | 58 | 31944 | 31963 | 689 |
| 547472 | 1641 | 1660 | TCACCTTTCTCCTTCGAGAA | 5-10-5 | 44 | n/a | n/a | 690 |
| 546331 | 1642 | 1661 | TTCACCTTTCTCCTTCGAGA | 5-10-5 | 59 | n/a | n/a | 691 |
| 547473 | 1649 | 1668 | TTTGGATTTCACCTTTCTCC | 5-10-5 | 5 | n/a | n/a | 692 |
| 547474 | 1659 | 1678 | TGTAGAATATTTTGGATTTC | 5-10-5 | 51 | 33103 | 33122 | 693 |
| 547475 | 1686 | 1705 | TTTGTTACCAAAGGAATATT | 5-10-5 | 44 | 33130 | 33149 | 694 |
| 547476 | 1688 | 1707 | CATTTGTTACCAAAGGAATA | 5-10-5 | 75 | 33132 | 33151 | 695 |
| 546336 | 1689 | 1708 | TCATTTGTTACCAAAGGAAT | 5-10-5 | 66 | 33133 | 33152 | 696 |
| 547477 | 1692 | 1711 | TCTTCATTTGTTACCAAAGG | 5-10-5 | 74 | 33136 | 33155 | 697 |
| 547478 | 1695 | 1714 | CATTCTTCATTTGTTACCAA | 5-10-5 | 85 | 33139 | 33158 | 698 |
| 546339 | 1712 | 1731 | CTTGATATCTTTTCTGGCAT | 5-10-5 | 65 | 33156 | 33175 | 699 |
| 546340 | 1716 | 1735 | TAATCTTGATATCTTTTCTG | 5-10-5 | 30 | 33160 | 33179 | 700 |
| 547479 | 1718 | 1737 | TATAATCTTGATATCTTTTC | 5-10-5 | 48 | 33162 | 33181 | 701 |
| 547480 | 1756 | 1775 | TTCTTTATAGCCAGCACAGA | 5-10-5 | 60 | 33200 | 33219 | 702 |
| 547481 | 1758 | 1777 | CCTTCTTTATAGCCAGCACA | 5-10-5 | 71 | 33202 | 33221 | 703 |
| 547482 | 1760 | 1779 | CCCCTTCTTTATAGCCAGCA | 5-10-5 | 90 | 33204 | 33223 | 704 |
| 546343 | 1761 | 1780 | CCCCCTTCTTTATAGCCAGC | 5-10-5 | 97 | 33205 | 33224 | 705 |
| 547483 | 1762 | 1781 | TCCCCCTTCTTTATAGCCAG | 5-10-5 | 71 | 33206 | 33225 | 706 |
| 546345 | 1773 | 1792 | CAAGCATCTTTTCCCCCTTC | 5-10-5 | 86 | 33217 | 33236 | 707 |
| 546346 | 1796 | 1815 | AGGGACCACCTGAATCTCCC | 5-10-5 | 83 | 33895 | 33914 | 708 |
| 547484 | 1799 | 1818 | CTAAGGGACCACCTGAATCT | 5-10-5 | 69 | 33898 | 33917 | 709 |
| 546347 | 1800 | 1819 | ACTAAGGGACCACCTGAATC | 5-10-5 | 28 | 33899 | 33918 | 710 |
| 547485 | 1803 | 1822 | CAAACTAAGGGACCACCTGA | 5-10-5 | 49 | 33902 | 33921 | 711 |
| 546348 | 1804 | 1823 | GCAAACTAAGGGACCACCTG | 5-10-5 | 79 | 33903 | 33922 | 712 |
| 547486 | 1805 | 1824 | TGCAAACTAAGGGACCACCT | 5-10-5 | 89 | 33904 | 33923 | 713 |

TABLE 130-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546349 | 1810 | 1829 | GTGTTTGCAAACTAAGGGAC | 5-10-5 | 48 | 33909 | 33928 | 714 |
| 547487 | 1811 | 1830 | TGTGTTTGCAAACTAAGGGA | 5-10-5 | 72 | 33910 | 33929 | 715 |
| 546350 | 1868 | 1887 | CCCTGCGGGCACAGCCTTCA | 5-10-5 | 88 | 33967 | 33986 | 716 |
| 546351 | 1873 | 1892 | TTGCTCCCTGCGGGCACAGC | 5-10-5 | 82 | 33972 | 33991 | 717 |
| 546352 | 1880 | 1899 | CACCAGGTTGCTCCCTGCGG | 5-10-5 | 75 | 33979 | 33998 | 718 |
| 547488 | 1881 | 1900 | ACACCAGGTTGCTCCCTGCG | 5-10-5 | 71 | 33980 | 33999 | 719 |

TABLE 131

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 531231 | n/a | n/a | TATCACTGTACTAGTTTCCT | 5-10-5 | 72 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547448 | 1451 | 1470 | TTATTTGTGAGAAAGGTGTA | 5-10-5 | 83 | 30529 | 30548 | 643 |
| 547449 | 1453 | 1472 | TTTTATTTGTGAGAAAGGTG | 5-10-5 | 73 | 30531 | 30550 | 644 |
| 546304 | 1454 | 1473 | CTTTTATTTGTGAGAAAGGT | 5-10-5 | 86 | 30532 | 30551 | 645 |
| 547450 | 1456 | 1475 | CTCTTTTATTTGTGAGAAAG | 5-10-5 | 67 | 30534 | 30553 | 646 |
| 547451 | 1471 | 1490 | TTGGTGAATAATAATCTCTT | 5-10-5 | 64 | 30549 | 30568 | 647 |
| 546306 | 1472 | 1491 | TTTGGTGAATAATAATCTCT | 5-10-5 | 71 | 30550 | 30569 | 648 |
| 547452 | 1474 | 1493 | GTTTTGGTGAATAATAATCT | 5-10-5 | 62 | 30552 | 30571 | 649 |
| 546307 | 1478 | 1497 | TATAGTTTTGGTGAATAATA | 5-10-5 | 0 | 30556 | 30575 | 650 |
| 546308 | 1482 | 1501 | ACTTTATAGTTTTGGTGAAT | 5-10-5 | 43 | 30560 | 30579 | 651 |
| 546309 | 1492 | 1511 | CCCTTCTGAGACTTTATAGT | 5-10-5 | 81 | 30570 | 30589 | 652 |
| 546310 | 1496 | 1515 | GATTCCCTTCTGAGACTTTA | 5-10-5 | 67 | 30574 | 30593 | 653 |
| 546311 | 1499 | 1518 | CATGATTCCCTTCTGAGACT | 5-10-5 | 76 | 30577 | 30596 | 654 |
| 547453 | 1500 | 1519 | TCATGATTCCCTTCTGAGAC | 5-10-5 | 81 | 30578 | 30597 | 655 |
| 547454 | 1502 | 1521 | TATCATGATTCCCTTCTGAG | 5-10-5 | 78 | 30580 | 30599 | 656 |
| 547455 | 1503 | 1522 | ATATCATGATTCCCTTCTGA | 5-10-5 | 66 | 30581 | 30600 | 657 |

TABLE 131-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 547456 | 1506 | 1525 | GCGATATCATGATTCCCTTC | 5-10-5 | 96 | 30584 | 30603 | 658 |
| 546313 | 1507 | 1526 | GGCGATATCATGATTCCCTT | 5-10-5 | 75 | 30585 | 30604 | 659 |
| 547457 | 1509 | 1528 | AAGGCGATATCATGATTCCC | 5-10-5 | 92 | 30587 | 30606 | 660 |
| 547458 | 1513 | 1532 | TATCAAGGCGATATCATGAT | 5-10-5 | 64 | 30591 | 30610 | 661 |
| 547459 | 1519 | 1538 | GAGTTTTATCAAGGCGATAT | 5-10-5 | 51 | 30597 | 30616 | 662 |
| 547460 | 1522 | 1541 | CTGGAGTTTTATCAAGGCGA | 5-10-5 | 75 | 30600 | 30619 | 663 |
| 546316 | 1524 | 1543 | GCCTGGAGTTTTATCAAGGC | 5-10-5 | 60 | 30602 | 30621 | 664 |
| 546317 | 1528 | 1547 | AGGAGCCTGGAGTTTTATCA | 5-10-5 | 31 | 30606 | 30625 | 665 |
| 546318 | 1534 | 1553 | ATTCAAAGGAGCCTGGAGTT | 5-10-5 | 46 | 30612 | 30631 | 666 |
| 547461 | 1537 | 1556 | GTAATTCAAAGGAGCCTGGA | 5-10-5 | 55 | 30615 | 30634 | 667 |
| 547462 | 1539 | 1558 | GTGTAATTCAAAGGAGCCTG | 5-10-5 | 54 | 30617 | 30636 | 668 |
| 546319 | 1541 | 1560 | CAGTGTAATTCAAAGGAGCC | 5-10-5 | 61 | 30619 | 30638 | 669 |
| 547463 | 1564 | 1583 | TAGGCATATTGGTTTTTGGA | 5-10-5 | 84 | 31870 | 31889 | 670 |
| 546320 | 1566 | 1585 | GGTAGGCATATTGGTTTTTG | 5-10-5 | 69 | 31872 | 31891 | 671 |
| 546321 | 1569 | 1588 | GAAGGTAGGCATATTGGTTT | 5-10-5 | 56 | 31875 | 31894 | 672 |
| 546322 | 1584 | 1603 | CTTGTGTCACCTTTGGAAGG | 5-10-5 | 68 | 31890 | 31909 | 673 |
| 547464 | 1585 | 1604 | GCTTGTGTCACCTTTGGAAG | 5-10-5 | 84 | 31891 | 31910 | 674 |
| 546323 | 1587 | 1606 | GTGCTTGTGTCACCTTTGGA | 5-10-5 | 80 | 31893 | 31912 | 675 |
| 547465 | 1592 | 1611 | AAATTGTGCTTGTGTCACCT | 5-10-5 | 85 | 31898 | 31917 | 676 |
| 547466 | 1596 | 1615 | GTATAAATTGTGCTTGTGTC | 5-10-5 | 43 | 31902 | 31921 | 677 |
| 546324 | 1597 | 1616 | GGTATAAATTGTGCTTGTGT | 5-10-5 | 82 | 31903 | 31922 | 678 |
| 547467 | 1598 | 1617 | TGGTATAAATTGTGCTTGTG | 5-10-5 | 65 | 31904 | 31923 | 679 |
| 547468 | 1600 | 1619 | GTTGGTATAAATTGTGCTTG | 5-10-5 | 46 | 31906 | 31925 | 680 |
| 546325 | 1602 | 1621 | CAGTTGGTATAAATTGTGCT | 5-10-5 | 79 | 31908 | 31927 | 681 |
| 546326 | 1607 | 1626 | CCCAACAGTTGGTATAAATT | 5-10-5 | 64 | 31913 | 31932 | 682 |
| 547469 | 1610 | 1629 | TTACCCAACAGTTGGTATAA | 5-10-5 | 50 | 31916 | 31935 | 683 |
| 546327 | 1612 | 1631 | GGTTACCCAACAGTTGGTAT | 5-10-5 | 84 | 31918 | 31937 | 684 |
| 546328 | 1624 | 1643 | GAAGCCCCATCCGGTTACCC | 5-10-5 | 81 | 31930 | 31949 | 685 |
| 547470 | 1628 | 1647 | TCGAGAAGCCCCATCCGGTT | 5-10-5 | 68 | 31934 | 31953 | 686 |
| 546329 | 1631 | 1650 | CCTTCGAGAAGCCCCATCCG | 5-10-5 | 8 | 31937 | 31956 | 687 |
| 546330 | 1636 | 1655 | TTTCTCCTTCGAGAAGCCCC | 5-10-5 | 67 | 31942 | 31961 | 688 |
| 547471 | 1638 | 1657 | CCTTTCTCCTTCGAGAAGCC | 5-10-5 | 43 | 31944 | 31963 | 689 |
| 547472 | 1641 | 1660 | TCACCTTTCTCCTTCGAGAA | 5-10-5 | 42 | n/a | n/a | 690 |
| 546331 | 1642 | 1661 | TTCACCTTTCTCCTTCGAGA | 5-10-5 | 44 | n/a | n/a | 691 |
| 547473 | 1649 | 1668 | TTTGGATTTCACCTTTCTCC | 5-10-5 | 26 | n/a | n/a | 692 |
| 547474 | 1659 | 1678 | TGTAGAATATTTGGATTTC | 5-10-5 | 34 | 33103 | 33122 | 693 |
| 547475 | 1686 | 1705 | TTTGTTACCAAAGGAATATT | 5-10-5 | 42 | 33130 | 33149 | 694 |

TABLE 131-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 547476 | 1688 | 1707 | CATTTGTTACCAAAGGAATA | 5-10-5 | 71 | 33132 | 33151 | 695 |
| 546336 | 1689 | 1708 | TCATTTGTTACCAAAGGAAT | 5-10-5 | 73 | 33133 | 33152 | 696 |
| 547477 | 1692 | 1711 | TCTTCATTTGTTACCAAAGG | 5-10-5 | 68 | 33136 | 33155 | 697 |
| 547478 | 1695 | 1714 | CATTCTTCATTTGTTACCAA | 5-10-5 | 55 | 33139 | 33158 | 698 |
| 546339 | 1712 | 1731 | CTTGATATCTTTTCTGGCAT | 5-10-5 | 64 | 33156 | 33175 | 699 |
| 546340 | 1716 | 1735 | TAATCTTGATATCTTTTCTG | 5-10-5 | 56 | 33160 | 33179 | 700 |
| 547479 | 1718 | 1737 | TATAATCTTGATATCTTTTC | 5-10-5 | 9 | 33162 | 33181 | 701 |
| 547480 | 1756 | 1775 | TTCTTTATAGCCAGCACAGA | 5-10-5 | 49 | 33200 | 33219 | 702 |
| 547481 | 1758 | 1777 | CCTTCTTTATAGCCAGCACA | 5-10-5 | 77 | 33202 | 33221 | 703 |
| 547482 | 1760 | 1779 | CCCCTTCTTTATAGCCAGCA | 5-10-5 | 65 | 33204 | 33223 | 704 |
| 546343 | 1761 | 1780 | CCCCCTTCTTTATAGCCAGC | 5-10-5 | 91 | 33205 | 33224 | 705 |
| 547483 | 1762 | 1781 | TCCCCCTTCTTTATAGCCAG | 5-10-5 | 77 | 33206 | 33225 | 706 |
| 546345 | 1773 | 1792 | CAAGCATCTTTTCCCCCTTC | 5-10-5 | 80 | 33217 | 33236 | 707 |
| 546346 | 1796 | 1815 | AGGGACCACCTGAATCTCCC | 5-10-5 | 70 | 33895 | 33914 | 708 |
| 547484 | 1799 | 1818 | CTAAGGGACCACCTGAATCT | 5-10-5 | 64 | 33898 | 33917 | 709 |
| 546347 | 1800 | 1819 | ACTAAGGGACCACCTGAATC | 5-10-5 | 22 | 33899 | 33918 | 710 |
| 547485 | 1803 | 1822 | CAAACTAAGGGACCACCTGA | 5-10-5 | 66 | 33902 | 33921 | 711 |
| 546348 | 1804 | 1823 | GCAAACTAAGGGACCACCTG | 5-10-5 | 76 | 33903 | 33922 | 712 |
| 547486 | 1805 | 1824 | TGCAAACTAAGGGACCACCT | 5-10-5 | 78 | 33904 | 33923 | 713 |
| 546349 | 1810 | 1829 | GTGTTTGCAAACTAAGGGAC | 5-10-5 | 35 | 33909 | 33928 | 714 |
| 547487 | 1811 | 1830 | TGTGTTTGCAAACTAAGGGA | 5-10-5 | 61 | 33910 | 33929 | 715 |
| 546350 | 1868 | 1887 | CCCTGCGGGCACAGCCTTCA | 5-10-5 | 74 | 33967 | 33986 | 716 |
| 546351 | 1873 | 1892 | TTGCTCCCTGCGGGCACAGC | 5-10-5 | 60 | 33972 | 33991 | 717 |
| 546352 | 1880 | 1899 | CACCAGGTTGCTCCCTGCGG | 5-10-5 | 74 | 33979 | 33998 | 718 |
| 547488 | 1881 | 1900 | ACACCAGGTTGCTCCCTGCG | 5-10-5 | 72 | 33980 | 33999 | 719 |

TABLE 132

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 531231 | n/a | n/a | TATCACTGTACTAGTTTCCT | 5-10-5 | 90 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |

TABLE 132-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 547489 | 1883 | 1902 | AGACACCAGGTTGCTCCCTG | 5-10-5 | 34 | 33982 | 34001 | 720 |
| 547490 | 1885 | 1904 | GTAGACACCAGGTTGCTCCC | 5-10-5 | 55 | 33984 | 34003 | 721 |
| 546353 | 1900 | 1919 | CTCAGCGACTTTGGTGTAGA | 5-10-5 | 55 | 33999 | 34018 | 722 |
| 546354 | 1903 | 1922 | GTACTCAGCGACTTTGGTGT | 5-10-5 | 47 | 34002 | 34021 | 723 |
| 547491 | 1906 | 1925 | CATGTACTCAGCGACTTTGG | 5-10-5 | 47 | 34005 | 34024 | 724 |
| 547492 | 1911 | 1930 | CAGTCCATGTACTCAGCGAC | 5-10-5 | 62 | 34010 | 34029 | 725 |
| 546356 | 1913 | 1932 | TCCAGTCCATGTACTCAGCG | 5-10-5 | 60 | 34012 | 34031 | 726 |
| 546357 | 1947 | 1966 | GCTTTTCCATCACTGCTCTG | 5-10-5 | 79 | 34046 | 34065 | 727 |
| 546358 | 1951 | 1970 | CTGAGCTTTTCCATCACTGC | 5-10-5 | 83 | 34050 | 34069 | 728 |
| 547493 | 1952 | 1971 | TCTGAGCTTTTCCATCACTG | 5-10-5 | 72 | 34051 | 34070 | 729 |
| 546359 | 1955 | 1974 | GCATCTGAGCTTTTCCATCA | 5-10-5 | 79 | 34054 | 34073 | 730 |
| 546360 | 1958 | 1977 | ACTGCATCTGAGCTTTTCCA | 5-10-5 | 13 | 34057 | 34076 | 731 |
| 547494 | 1963 | 1982 | TGGTGACTGCATCTGAGCTT | 5-10-5 | 70 | 34062 | 34081 | 732 |
| 547495 | 1965 | 1984 | GCTGGTGACTGCATCTGAGC | 5-10-5 | 61 | 34064 | 34083 | 733 |
| 547496 | 1967 | 1986 | ATGCTGGTGACTGCATCTGA | 5-10-5 | 80 | 34066 | 34085 | 734 |
| 546362 | 1969 | 1988 | TCATGCTGGTGACTGCATCT | 5-10-5 | 71 | 34068 | 34087 | 735 |
| 546363 | 1973 | 1992 | CTTCTCATGCTGGTGACTGC | 5-10-5 | 81 | 34072 | 34091 | 736 |
| 547497 | 1977 | 1996 | ACTGCTTCTCATGCTGGTGA | 5-10-5 | 68 | 34076 | 34095 | 737 |
| 546364 | 1979 | 1998 | GGACTGCTTCTCATGCTGGT | 5-10-5 | 61 | 34078 | 34097 | 738 |
| 547498 | 1981 | 2000 | CTGGACTGCTTCTCATGCTG | 5-10-5 | 44 | 34080 | 34099 | 739 |
| 547499 | 1983 | 2002 | CTCTGGACTGCTTCTCATGC | 5-10-5 | 65 | 34082 | 34101 | 740 |
| 546365 | 1986 | 2005 | AGACTCTGGACTGCTTCTCA | 5-10-5 | 64 | 34085 | 34104 | 741 |
| 547500 | 1989 | 2008 | CCTAGACTCTGGACTGCTTC | 5-10-5 | 65 | 34088 | 34107 | 742 |
| 546366 | 1991 | 2010 | TGCCTAGACTCTGGACTGCT | 5-10-5 | 79 | 34090 | 34109 | 743 |
| 547501 | 1993 | 2012 | ATTGCCTAGACTCTGGACTG | 5-10-5 | 55 | 34092 | 34111 | 744 |
| 546367 | 1997 | 2016 | AAAAATTGCCTAGACTCTGG | 5-10-5 | 61 | 34096 | 34115 | 745 |
| 546368 | 2003 | 2022 | GGTTGTAAAAATTGCCTAGA | 5-10-5 | 44 | 34102 | 34121 | 746 |
| 547502 | 2006 | 2025 | TCAGGTTGTAAAAATTGCCT | 5-10-5 | 64 | 34105 | 34124 | 747 |
| 546369 | 2007 | 2026 | CTCAGGTTGTAAAAATTGCC | 5-10-5 | 51 | 34106 | 34125 | 748 |
| 547503 | 2008 | 2027 | ACTCAGGTTGTAAAAATTGC | 5-10-5 | 66 | 34107 | 34126 | 749 |
| 547504 | 2010 | 2029 | GAACTCAGGTTGTAAAAATT | 5-10-5 | 37 | 34109 | 34128 | 750 |
| 546370 | 2014 | 2033 | ACTTGAACTCAGGTTGTAAA | 5-10-5 | 34 | 34113 | 34132 | 751 |
| 547505 | 2015 | 2034 | GACTTGAACTCAGGTTGTAA | 5-10-5 | 69 | 34114 | 34133 | 752 |

TABLE 132-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546372 | 2021 | 2040 | GAATTTGACTTGAACTCAGG | 5-10-5 | 49 | 34120 | 34139 | 753 |
| 546373 | 2025 | 2044 | CTCAGAATTTGACTTGAACT | 5-10-5 | 59 | 34124 | 34143 | 754 |
| 547506 | 2028 | 2047 | AGGCTCAGAATTTGACTTGA | 5-10-5 | 78 | 34127 | 34146 | 755 |
| 547507 | 2029 | 2048 | CAGGCTCAGAATTTGACTTG | 5-10-5 | 56 | 34128 | 34147 | 756 |
| 546374 | 2030 | 2049 | CCAGGCTCAGAATTTGACTT | 5-10-5 | 50 | 34129 | 34148 | 757 |
| 547508 | 2032 | 2051 | CCCCAGGCTCAGAATTTGAC | 5-10-5 | 69 | 34131 | 34150 | 758 |
| 547509 | 2034 | 2053 | CCCCCCAGGCTCAGAATTTG | 5-10-5 | 58 | 34133 | 34152 | 759 |
| 546375 | 2036 | 2055 | GACCCCCCAGGCTCAGAATT | 5-10-5 | 48 | 34135 | 34154 | 760 |
| 547510 | 2041 | 2060 | ATGAGGACCCCCAGGCTCA | 5-10-5 | 40 | 34140 | 34159 | 761 |
| 547511 | 2042 | 2061 | GATGAGGACCCCCCAGGCTC | 5-10-5 | 53 | 34141 | 34160 | 762 |
| 547512 | 2045 | 2064 | GCAGATGAGGACCCCCCAGG | 5-10-5 | 74 | 34144 | 34163 | 763 |
| 547513 | 2046 | 2065 | TGCAGATGAGGACCCCCCAG | 5-10-5 | 72 | 34145 | 34164 | 764 |
| 546378 | 2048 | 2067 | TTTGCAGATGAGGACCCCCC | 5-10-5 | 79 | 34147 | 34166 | 765 |
| 546379 | 2056 | 2075 | CTCCATGCTTTGCAGATGAG | 5-10-5 | 69 | 34155 | 34174 | 766 |
| 546380 | 2062 | 2081 | GCCACTCTCCATGCTTTGCA | 5-10-5 | 81 | 34161 | 34180 | 767 |
| 547514 | 2066 | 2085 | AGATGCCACTCTCCATGCTT | 5-10-5 | 85 | 34165 | 34184 | 768 |
| 546381 | 2068 | 2087 | GAAGATGCCACTCTCCATGC | 5-10-5 | 73 | 34167 | 34186 | 769 |
| 547515 | 2069 | 2088 | AGAAGATGCCACTCTCCATG | 5-10-5 | 58 | 34168 | 34187 | 770 |
| 546382 | 2072 | 2091 | CAAAGAAGATGCCACTCTCC | 5-10-5 | 58 | 34171 | 34190 | 771 |
| 547516 | 2076 | 2095 | GATGCAAAGAAGATGCCACT | 5-10-5 | 48 | 34175 | 34194 | 772 |
| 546383 | 2077 | 2096 | GGATGCAAAGAAGATGCCAC | 5-10-5 | 57 | 34176 | 34195 | 773 |
| 547517 | 2079 | 2098 | TAGGATGCAAAGAAGATGCC | 5-10-5 | 57 | 34178 | 34197 | 774 |
| 547518 | 2083 | 2102 | TCCTTAGGATGCAAAGAAGA | 5-10-5 | 51 | 34182 | 34201 | 775 |
| 546384 | 2085 | 2104 | CGTCCTTAGGATGCAAAGAA | 5-10-5 | 81 | 34184 | 34203 | 776 |
| 546385 | 2120 | 2139 | ATTGTCCTCAGCAGCTCTGA | 5-10-5 | 67 | 34219 | 34238 | 777 |
| 547519 | 2126 | 2145 | CCAGACATTGTCCTCAGCAG | 5-10-5 | 76 | 34225 | 34244 | 778 |
| 546386 | 2128 | 2147 | AGCCAGACATTGTCCTCAGC | 5-10-5 | 78 | 34227 | 34246 | 779 |
| 547520 | 2130 | 2149 | TCAGCCAGACATTGTCCTCA | 5-10-5 | 76 | 34229 | 34248 | 780 |
| 547521 | 2132 | 2151 | CTTCAGCCAGACATTGTCCT | 5-10-5 | 58 | 34231 | 34250 | 781 |
| 546387 | 2138 | 2157 | AGCGGGCTTCAGCCAGACAT | 5-10-5 | 77 | 34237 | 34256 | 782 |
| 547522 | 2141 | 2160 | GAAAGCGGGCTTCAGCCAGA | 5-10-5 | 73 | 34240 | 34259 | 783 |
| 546388 | 2143 | 2162 | CTGAAAGCGGGCTTCAGCCA | 5-10-5 | 71 | 34242 | 34261 | 784 |
| 546389 | 2147 | 2166 | CGTGCTGAAAGCGGGCTTCA | 5-10-5 | 71 | 34246 | 34265 | 785 |
| 546390 | 2165 | 2184 | GTCAGCCCTGGTTACGGCG | 5-10-5 | 70 | 34264 | 34283 | 786 |
| 547523 | 2167 | 2186 | TTGTCAGCCCTGGTTACGG | 5-10-5 | 69 | 34266 | 34285 | 787 |
| 547524 | 2169 | 2188 | CATTGTCAGCCCCTGGTTAC | 5-10-5 | 58 | 34268 | 34287 | 788 |

TABLE 132-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546391 | 2170 | 2189 | GCATTGTCAGCCCCTGGTTA | 5-10-5 | 54 | 34269 | 34288 | 789 |
| 547525 | 2174 | 2193 | CCTCGCATTGTCAGCCCCTG | 5-10-5 | 78 | 34273 | 34292 | 790 |
| 546392 | 2176 | 2195 | GACCTCGCATTGTCAGCCCC | 5-10-5 | 72 | 34275 | 34294 | 791 |
| 547526 | 2178 | 2197 | GCGACCTCGCATTGTCAGCC | 5-10-5 | 59 | 34277 | 34296 | 792 |
| 547527 | 2185 | 2204 | CTCAGTTGCGACCTCGCATT | 5-10-5 | 58 | 34284 | 34303 | 793 |
| 546393 | 2186 | 2205 | TCTCAGTTGCGACCTCGCAT | 5-10-5 | 77 | 34285 | 34304 | 794 |
| 546394 | 2196 | 2215 | GTCATGGAGATCTCAGTTGC | 5-10-5 | 71 | 34295 | 34314 | 795 |
| 547528 | 2200 | 2219 | CACAGTCATGGAGATCTCAG | 5-10-5 | 78 | 34299 | 34318 | 796 |

TABLE 133

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 531231 | n/a | n/a | TATCACTGTACTAGTTTCCT | 5-10-5 | 90 | 14744<br>14815<br>14886<br>14945<br>15005<br>15077<br>15220<br>15292<br>15351<br>15411<br>15483<br>15555<br>15613<br>15685<br>15815<br>15887<br>15945 | 14763<br>14834<br>14905<br>14964<br>15024<br>15096<br>15239<br>15311<br>15370<br>15430<br>15502<br>15574<br>15632<br>15704<br>15834<br>15906<br>15964 | 334 |
| 546403 | n/a | n/a | CCATGAACATCCTATCCGTG | 5-10-5 | 83 | 3282 | 3301 | 797 |
| 546406 | n/a | n/a | TGTCCTGTCAACATATTCCA | 5-10-5 | 80 | 3299 | 3318 | 798 |
| 546409 | n/a | n/a | GGGTTTCTGCCAACAGTTTC | 5-10-5 | 77 | 3326 | 3345 | 799 |
| 546410 | n/a | n/a | GACTTTGGGTTTCTGCCAAC | 5-10-5 | 83 | 3332 | 3351 | 800 |
| 546411 | n/a | n/a | ATATTGACTTTGGGTTTCTG | 5-10-5 | 56 | 3337 | 3356 | 801 |
| 546412 | n/a | n/a | GGCTTCAATATTGACTTTGG | 5-10-5 | 84 | 3344 | 3363 | 802 |
| 546416 | n/a | n/a | CTGCAGGCAATATTTTGCTT | 5-10-5 | 62 | 3364 | 3383 | 803 |
| 546418 | n/a | n/a | ATGTGGCACTGCAGGCAATA | 5-10-5 | 72 | 3372 | 3391 | 804 |
| 546419 | n/a | n/a | TTCTAATGTGGCACTGCAGG | 5-10-5 | 65 | 3377 | 3396 | 805 |
| 546421 | n/a | n/a | TCAAGCTGTTCTAATGTGGC | 5-10-5 | 71 | 3385 | 3404 | 806 |
| 546422 | n/a | n/a | ACGGTCTTCAAGCTGTTCTA | 5-10-5 | 72 | 3392 | 3411 | 807 |
| 546425 | n/a | n/a | GGTCAATCTGACTAGTGAAT | 5-10-5 | 69 | 2284 | 2303 | 808 |
| 546426 | n/a | n/a | TCTCTGGTCAATCTGACTAG | 5-10-5 | 49 | 2289 | 2308 | 809 |
| 546429 | n/a | n/a | GCCCACCAACAATCTCTGGT | 5-10-5 | 84 | 2301 | 2320 | 810 |

TABLE 133-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546432 | n/a | n/a | GACCCCAACAGACAGCCCAC | 5-10-5 | 62 | 2315 | 2334 | 811 |
| 546444 | n/a | n/a | CCAGAATCATGCCTTGTGGG | 5-10-5 | 61 | 4765 | 4784 | 812 |
| 546447 | n/a | n/a | GTCACCATAGACCCAGAATC | 5-10-5 | 68 | 4777 | 4796 | 813 |
| 546450 | n/a | n/a | GTGGCCCTCTTAAGTCACCA | 5-10-5 | 73 | 4790 | 4809 | 814 |
| 546453 | n/a | n/a | CTCATTGTTGTGTGGCCCTC | 5-10-5 | 82 | 4801 | 4820 | 815 |
| 546459 | n/a | n/a | GTAGCCATACATCTGAGGAA | 5-10-5 | 46 | 4830 | 4849 | 816 |
| 546461 | n/a | n/a | ATGTTTATTGTAGCCATACA | 5-10-5 | 53 | 4839 | 4858 | 817 |
| 546492 | n/a | n/a | CTCGCCTTTGTGACTCGATT | 5-10-5 | 61 | 26263 | 26282 | 818 |
| 546493 | n/a | n/a | CATACTCGCCTTTGTGACTC | 5-10-5 | 35 | 26267 | 26286 | 819 |
| 546494 | n/a | n/a | GCATACTCGCCTTTGTGACT | 5-10-5 | 67 | 26268 | 26287 | 820 |
| 546495 | n/a | n/a | TGCATACTCGCCTTTGTGAC | 5-10-5 | 65 | 26269 | 26288 | 821 |
| 546395 | 2209 | 2228 | TTCACAACACACAGTCATGG | 5-10-5 | 72 | 34308 | 34327 | 822 |
| 546397 | 2233 | 2252 | TTTTTTGATCTTTCACCATT | 5-10-5 | 55 | n/a | n/a | 823 |
| 546496 | n/a | n/a | ATGCATACTCGCCTTTGTGA | 5-10-5 | 54 | 26270 26301 | 26289 26320 | 824 |
| 546497 | n/a | n/a | CATGCATACTCGCCTTTGTG | 5-10-5 | 56 | 26271 26302 | 26290 26321 | 825 |
| 546498 | n/a | n/a | CCATGCATACTCGCCTTTGT | 5-10-5 | 65 | 26272 26303 | 26291 26322 | 826 |
| 547529 | 2203 | 2222 | ACACACAGTCATGGAGATCT | 5-10-5 | 49 | 34302 | 34321 | 827 |
| 547530 | 2206 | 2225 | ACAACACAGTCATGGAGA | 5-10-5 | 63 | 34305 | 34324 | 828 |
| 547531 | 2213 | 2232 | TTATTTCACAACACACAGTC | 5-10-5 | 69 | 34312 | 34331 | 829 |
| 546499 | n/a | n/a | TCCATGCATACTCGCCTTTG | 5-10-5 | 20 | 26273 | 26292 | 830 |
| 546500 | n/a | n/a | TTCCATGCATACTCGCCTTT | 5-10-5 | 46 | 26274 | 26293 | 831 |
| 546501 | n/a | n/a | TTTCCATGCATACTCGCCTT | 5-10-5 | 53 | 26275 | 26294 | 832 |
| 546502 | n/a | n/a | GATTTTCCATGCATACTCGC | 5-10-5 | 37 | 26278 | 26297 | 833 |
| 546503 | n/a | n/a | GTGATGCGATTTTCCATGCA | 5-10-5 | 53 | 26285 | 26304 | 834 |
| 546508 | n/a | n/a | GCAGCAAGTGCTCCCCATGC | 5-10-5 | 43 | 26317 | 26336 | 835 |
| 546511 | n/a | n/a | GTGATGAAAGTACAGCAGCA | 5-10-5 | 50 | 26331 | 26350 | 836 |
| 546683 | n/a | n/a | TCCTATCCGTGTTCAGCTGT | 5-10-5 | 69 | 3273 | 3292 | 837 |
| 546684 | n/a | n/a | TACTCTCTACATACTCAGGA | 5-10-5 | 71 | 3561 | 3580 | 838 |
| 546687 | n/a | n/a | TGAGACCTCCAGACTACTGT | 5-10-5 | 76 | 3847 | 3866 | 839 |
| 546690 | n/a | n/a | CTCTGCTGGTTTTAGACCAC | 5-10-5 | 44 | 4027 | 4046 | 840 |
| 546695 | n/a | n/a | GGGACAATCTCCACCCCCGA | 5-10-5 | 36 | 4225 | 4244 | 841 |
| 546698 | n/a | n/a | TGCAGAGTGTCATCTGCGAA | 5-10-5 | 59 | 4387 | 4406 | 842 |
| 546700 | n/a | n/a | TGGTTCCCTAGCGGTCCAGA | 5-10-5 | 78 | 4561 | 4580 | 843 |
| 546705 | n/a | n/a | CCCCTGTAGTTGGCTGTGGT | 5-10-5 | 66 | 5046 | 5065 | 844 |
| 546707 | n/a | n/a | GCAAGTCAAAGAGTGTCCAC | 5-10-5 | 73 | 5283 | 5302 | 845 |

TABLE 133-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546710 | n/a | n/a | GAAGCCTGTTAGAGTTGGCC | 5-10-5 | 73 | 5576 | 5595 | 846 |
| 546719 | n/a | n/a | CCCCCATGTCCATGGACTTT | 5-10-5 | 55 | 6329 | 6348 | 847 |
| 547532 | n/a | n/a | CTGCCAACAGTTTCAACTTT | 5-10-5 | 65 | 3320 | 3339 | 848 |
| 547533 | n/a | n/a | TTTTGCTTGGCTTCAATATT | 5-10-5 | 23 | 3352 | 3371 | 849 |
| 547534 | n/a | n/a | ATCTGACTAGTGAATGGCTT | 5-10-5 | 72 | 2279 | 2298 | 850 |
| 547535 | n/a | n/a | AGACAGCCCACCAACAATCT | 5-10-5 | 28 | 2306 | 2325 | 851 |
| 547536 | n/a | n/a | TGCATAGACCCCAACAGACA | 5-10-5 | 48 | 2321 | 2340 | 852 |
| 547537 | n/a | n/a | CCTGTGCATAGACCCCAACA | 5-10-5 | 65 | 2325 | 2344 | 853 |
| 547538 | n/a | n/a | CCAGCAGAAATCCTGTGCAT | 5-10-5 | 77 | 2336 | 2355 | 854 |
| 547539 | n/a | n/a | AGAACTCCAGCAGAAATCCT | 5-10-5 | 43 | 2342 | 2361 | 855 |
| 547540 | n/a | n/a | TTGTGTGGCCCTCTTAAGTC | 5-10-5 | 44 | 4794 | 4813 | 856 |
| 547541 | n/a | n/a | TATAGATGTTTATTGTAGCC | 5-10-5 | 36 | 4844 | 4863 | 857 |
| 547542 | n/a | n/a | ATACTCGCCTTTGTGACTCG | 5-10-5 | 35 | 26266 | 26285 | 858 |
| 547543 | n/a | n/a | TTTTCCATGCATACTCGCCT | 5-10-5 | 54 | 26276 | 26295 | 859 |
| 547544 | n/a | n/a | TCGCCTTTGTGATGCGATTT | 5-10-5 | 15 | 26293 | 26312 | 860 |
| 547545 | n/a | n/a | ATACTCGCCTTTGTGATGCG | 5-10-5 | 43 | 26297 | 26316 | 861 |
| 547546 | n/a | n/a | CATACTCGCCTTTGTGATGC | 5-10-5 | 11 | 26298 | 26317 | 862 |
| 547547 | n/a | n/a | GCATACTCGCCTTTGTGATG | 5-10-5 | 42 | 26299 | 26318 | 863 |
| 547548 | n/a | n/a | TGCATACTCGCCTTTGTGAT | 5-10-5 | 61 | 26300 | 26319 | 864 |
| 547549 | n/a | n/a | CCCATGCATACTCGCCTTTG | 5-10-5 | 36 | 26304 | 26323 | 865 |
| 547550 | n/a | n/a | CCCCATGCATACTCGCCTTT | 5-10-5 | 53 | 26305 | 26324 | 866 |
| 547551 | n/a | n/a | TCCCCATGCATACTCGCCTT | 5-10-5 | 38 | 26306 | 26325 | 867 |
| 547552 | n/a | n/a | CTCCCCATGCATACTCGCCT | 5-10-5 | 53 | 26307 | 26326 | 868 |
| 547553 | n/a | n/a | TGCTCCCCATGCATACTCGC | 5-10-5 | 64 | 26309 | 26328 | 869 |
| 547554 | n/a | n/a | GCTCTGATTGGGTCACCACA | 5-10-5 | 50 | 5743 | 5762 | 870 |
| 547555 | n/a | n/a | TGTCTCCTTCCACTTGCTCC | 5-10-5 | 58 | 5923 | 5942 | 871 |
| 547556 | n/a | n/a | GCCATTTTATCCCTGAGATT | 5-10-5 | 55 | 6130 | 6149 | 872 |
| 547557 | n/a | n/a | CTGTGCTGTATTTTGGAGCC | 5-10-5 | 59 | 6413 | 6432 | 873 |

TABLE 134

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 531231 | n/a | n/a | TATCACTGTACTAGTTTCCT | 5-10-5 | 85 | 14744 14815 14886 14945 | 14763 14834 14905 14964 | 334 |

TABLE 134-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 546732 | n/a | n/a | GGATTTGGCCCTGAGCCCCA | 5-10-5 | 14 | 6933 | 6952 | 874 |
| 546735 | n/a | n/a | CAACCTGTCCATTCCCTGGG | 5-10-5 | 46 | 7082 | 7101 | 875 |
| 546739 | n/a | n/a | ATTCGGTGTCTTTACTGGCT | 5-10-5 | 89 | 7228 | 7247 | 876 |
| 546746 | n/a | n/a | TCCTGTTGCCTGACATGCTA | 5-10-5 | 65 | 7694 | 7713 | 877 |
| 546747 | n/a | n/a | CTCCCACTGACTGACTACTC | 5-10-5 | 64 | 7904 | 7923 | 878 |
| 546749 | n/a | n/a | GCTGGTCCTTGAACCCCGTG | 5-10-5 | 53 | 8259 | 8278 | 879 |
| 546753 | n/a | n/a | CTGGCTCACTATAGGCCCCA | 5-10-5 | 91 | 8655 | 8674 | 880 |
| 546756 | n/a | n/a | ATAAGCATCTCTCTGACCTA | 5-10-5 | 47 | 9105 | 9124 | 881 |
| 546763 | n/a | n/a | GCTTCCCCAATACTTGCTGG | 5-10-5 | 84 | 9695 | 9714 | 882 |
| 546765 | n/a | n/a | GTGTCCAGAATACTGCCCCA | 5-10-5 | 82 | 10053 | 10072 | 883 |
| 546770 | n/a | n/a | GTGGACGACTGCCCTGTGCC | 5-10-5 | 74 | 10435 | 10454 | 884 |
| 546773 | n/a | n/a | TCTCTAGCATCCTAGTCCTC | 5-10-5 | 67 | 10586 | 10605 | 885 |
| 546780 | n/a | n/a | ATACTGGCTAAGTCAGGCCC | 5-10-5 | 83 | 10982 | 11001 | 886 |
| 546784 | n/a | n/a | GGCAGGGAGGTGGATTATTC | 5-10-5 | 58 | 11440 | 11459 | 887 |
| 546789 | n/a | n/a | GCTTCTCTATCTCCCAGTGT | 5-10-5 | 79 | 12228 | 12247 | 888 |
| 546791 | n/a | n/a | GATGCATGCAGCAATACAGG | 5-10-5 | 52 | 12385 | 12404 | 889 |
| 546795 | n/a | n/a | GTCTCGATGGCAAGCTGTAC | 5-10-5 | 72 | 12650 | 12669 | 890 |
| 546796 | n/a | n/a | GTACTCACCGGTACTCTGCC | 5-10-5 | 82 | 12804 | 12823 | 891 |
| 546799 | n/a | n/a | ATGAAGGGCGAGGCGCAGTG | 5-10-5 | 5 | 13258 | 13277 | 892 |
| 546803 | n/a | n/a | CCCCATACATCTATGCAAAT | 5-10-5 | 40 | 13551 | 13570 | 893 |
| 546804 | n/a | n/a | ACATGACTCCAGTGATGGAT | 5-10-5 | 57 | 13632 | 13651 | 894 |
| 546808 | n/a | n/a | AAAATGACACCAAAATTCGC | 5-10-5 | 0 | 13841 | 13860 | 895 |
| 546811 | n/a | n/a | TGGACATCCTTCCCCTCGCA | 5-10-5 | 49 | 13967 | 13986 | 896 |
| 546817 | n/a | n/a | GCTCTGAGCCTTCCGCCTCT | 5-10-5 | 77 | 14472 | 14491 | 897 |
| 546822 | n/a | n/a | ACTAGTTTCCTATAACTGCT | 5-10-5 | 32 | 14735 | 14754 | 898 |
| 546823 | n/a | n/a | TACTAGTTTCCTATAACTGC | 5-10-5 | 44 | 14736 | 14755 | 899 |
| 546824 | n/a | n/a | GTACTAGTTTCCTATAACTG | 5-10-5 | 79 | 14737 | 14756 | 900 |
| 546825 | n/a | n/a | GTATCACTGTACTAGTTTCC | 5-10-5 | 96 | 14745 | 14764 | 901 |
| | | | | | | 14816 | 14835 | |
| | | | | | | 14887 | 14906 | |
| | | | | | | 14946 | 14965 | |
| | | | | | | 15006 | 15025 | |

TABLE 134-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| | | | | | | 15078 | 15097 | |
| | | | | | | 15221 | 15240 | |
| | | | | | | 15293 | 15312 | |
| | | | | | | 15352 | 15371 | |
| | | | | | | 15412 | 15431 | |
| | | | | | | 15484 | 15503 | |
| | | | | | | 15556 | 15575 | |
| | | | | | | 15614 | 15633 | |
| | | | | | | 15686 | 15705 | |
| | | | | | | 15816 | 15835 | |
| | | | | | | 15888 | 15907 | |
| | | | | | | 15946 | 15965 | |
| 546826 | n/a | n/a | AGTATCACTGTACTAGTTTC | 5-10-5 | 90 | 14746 | 14765 | 902 |
| | | | | | | 14817 | 14836 | |
| | | | | | | 14888 | 14907 | |
| | | | | | | 14947 | 14966 | |
| | | | | | | 15007 | 15026 | |
| | | | | | | 15079 | 15098 | |
| | | | | | | 15222 | 15241 | |
| | | | | | | 15294 | 15313 | |
| | | | | | | 15353 | 15372 | |
| | | | | | | 15413 | 15432 | |
| | | | | | | 15485 | 15504 | |
| | | | | | | 15557 | 15576 | |
| | | | | | | 15615 | 15634 | |
| | | | | | | 15687 | 15706 | |
| | | | | | | 15817 | 15836 | |
| | | | | | | 15889 | 15908 | |
| | | | | | | 15947 | 15966 | |
| 546827 | n/a | n/a | CAGTATCACTGTACTAGTTT | 5-10-5 | 98 | 14747 | 14766 | 903 |
| | | | | | | 14818 | 14837 | |
| | | | | | | 14889 | 14908 | |
| | | | | | | 14948 | 14967 | |
| | | | | | | 15008 | 15027 | |
| | | | | | | 15080 | 15099 | |
| | | | | | | 15152 | 15171 | |
| | | | | | | 15223 | 15242 | |
| | | | | | | 15295 | 15314 | |
| | | | | | | 15354 | 15373 | |
| | | | | | | 15414 | 15433 | |
| | | | | | | 15486 | 15505 | |
| | | | | | | 15558 | 15577 | |
| | | | | | | 15616 | 15635 | |
| | | | | | | 15688 | 15707 | |
| | | | | | | 15818 | 15837 | |
| | | | | | | 15890 | 15909 | |
| | | | | | | 15948 | 15967 | |
| 546828 | n/a | n/a | ACAGTATCACTGTACTAGTT | 5-10-5 | 95 | 14748 | 14767 | 904 |
| | | | | | | 14819 | 14838 | |
| | | | | | | 14890 | 14909 | |
| | | | | | | 14949 | 14968 | |
| | | | | | | 15009 | 15028 | |
| | | | | | | 15081 | 15100 | |
| | | | | | | 15153 | 15172 | |
| | | | | | | 15224 | 15243 | |
| | | | | | | 15296 | 15315 | |
| | | | | | | 15355 | 15374 | |
| | | | | | | 15415 | 15434 | |
| | | | | | | 15487 | 15506 | |
| | | | | | | 15559 | 15578 | |
| | | | | | | 15617 | 15636 | |
| | | | | | | 15689 | 15708 | |
| | | | | | | 15819 | 15838 | |
| | | | | | | 15891 | 15910 | |
| | | | | | | 15949 | 15968 | |

TABLE 134-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546829 | n/a | n/a | AACAGTATCACTGTACTAGT | 5-10-5 | 94 | 14749 | 14768 | 905 |
| | | | | | | 14820 | 14839 | |
| | | | | | | 14891 | 14910 | |
| | | | | | | 14950 | 14969 | |
| | | | | | | 15010 | 15029 | |
| | | | | | | 15082 | 15101 | |
| | | | | | | 15154 | 15173 | |
| | | | | | | 15225 | 15244 | |
| | | | | | | 15297 | 15316 | |
| | | | | | | 15356 | 15375 | |
| | | | | | | 15416 | 15435 | |
| | | | | | | 15488 | 15507 | |
| | | | | | | 15560 | 15579 | |
| | | | | | | 15618 | 15637 | |
| | | | | | | 15690 | 15709 | |
| | | | | | | 15820 | 15839 | |
| | | | | | | 15892 | 15911 | |
| | | | | | | 15950 | 15969 | |
| 546830 | n/a | n/a | TAACAGTATCACTGTACTAG | 5-10-5 | 78 | 14750 | 14769 | 906 |
| | | | | | | 14821 | 14840 | |
| | | | | | | 14892 | 14911 | |
| | | | | | | 14951 | 14970 | |
| | | | | | | 15011 | 15030 | |
| | | | | | | 15083 | 15102 | |
| | | | | | | 15155 | 15174 | |
| | | | | | | 15226 | 15245 | |
| | | | | | | 15298 | 15317 | |
| | | | | | | 15357 | 15376 | |
| | | | | | | 15417 | 15436 | |
| | | | | | | 15489 | 15508 | |
| | | | | | | 15561 | 15580 | |
| | | | | | | 15619 | 15638 | |
| | | | | | | 15691 | 15710 | |
| | | | | | | 15821 | 15840 | |
| | | | | | | 15893 | 15912 | |
| | | | | | | 15951 | 15970 | |
| 546831 | n/a | n/a | TCTAACAGTATCACTGTACT | 5-10-5 | 79 | 14752 | 14771 | 907 |
| | | | | | | 14823 | 14842 | |
| | | | | | | 14894 | 14913 | |
| | | | | | | 15013 | 15032 | |
| | | | | | | 15085 | 15104 | |
| | | | | | | 15228 | 15247 | |
| | | | | | | 15300 | 15319 | |
| | | | | | | 15419 | 15438 | |
| | | | | | | 15491 | 15510 | |
| | | | | | | 15621 | 15640 | |
| | | | | | | 15823 | 15842 | |
| | | | | | | 15953 | 15972 | |
| 546832 | n/a | n/a | CTCTAACAGTATCACTGTAC | 5-10-5 | 88 | 14753 | 14772 | 908 |
| | | | | | | 14824 | 14843 | |
| | | | | | | 14895 | 14914 | |
| | | | | | | 15014 | 15033 | |
| | | | | | | 15086 | 15105 | |
| | | | | | | 15229 | 15248 | |
| | | | | | | 15301 | 15320 | |
| | | | | | | 15420 | 15439 | |
| | | | | | | 15492 | 15511 | |
| | | | | | | 15622 | 15641 | |
| | | | | | | 15824 | 15843 | |
| | | | | | | 15954 | 15973 | |

TABLE 134-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546833 | n/a | n/a | ACTCTAACAGTATCACTGTA | 5-10-5 | 90 | 14754 | 14773 | 909 |
| | | | | | | 14825 | 14844 | |
| | | | | | | 14896 | 14915 | |
| | | | | | | 15015 | 15034 | |
| | | | | | | 15087 | 15106 | |
| | | | | | | 15230 | 15249 | |
| | | | | | | 15302 | 15321 | |
| | | | | | | 15421 | 15440 | |
| | | | | | | 15493 | 15512 | |
| | | | | | | 15623 | 15642 | |
| | | | | | | 15825 | 15844 | |
| | | | | | | 15955 | 15974 | |
| 546834 | n/a | n/a | AACTCTAACAGTATCACTGT | 5-10-5 | 86 | 14755 | 14774 | 910 |
| | | | | | | 14826 | 14845 | |
| | | | | | | 14897 | 14916 | |
| | | | | | | 15016 | 15035 | |
| | | | | | | 15088 | 15107 | |
| | | | | | | 15231 | 15250 | |
| | | | | | | 15303 | 15322 | |
| | | | | | | 15422 | 15441 | |
| | | | | | | 15494 | 15513 | |
| | | | | | | 15624 | 15643 | |
| | | | | | | 15826 | 15845 | |
| | | | | | | 15956 | 15975 | |
| 546835 | n/a | n/a | TAACTCTAACAGTATCACTG | 5-10-5 | 86 | 14756 | 14775 | 911 |
| | | | | | | 14827 | 14846 | |
| | | | | | | 14898 | 14917 | |
| | | | | | | 15017 | 15036 | |
| | | | | | | 15089 | 15108 | |
| | | | | | | 15232 | 15251 | |
| | | | | | | 15304 | 15323 | |
| | | | | | | 15423 | 15442 | |
| | | | | | | 15495 | 15514 | |
| | | | | | | 15625 | 15644 | |
| | | | | | | 15827 | 15846 | |
| | | | | | | 15957 | 15976 | |
| 546836 | n/a | n/a | ATAACTCTAACAGTATCACT | 5-10-5 | 30 | 14757 | 14776 | 912 |
| | | | | | | 14828 | 14847 | |
| | | | | | | 14899 | 14918 | |
| | | | | | | 15018 | 15037 | |
| | | | | | | 15090 | 15109 | |
| | | | | | | 15233 | 15252 | |
| | | | | | | 15305 | 15324 | |
| | | | | | | 15424 | 15443 | |
| | | | | | | 15496 | 15515 | |
| | | | | | | 15626 | 15645 | |
| | | | | | | 15828 | 15847 | |
| | | | | | | 15958 | 15977 | |
| 546837 | n/a | n/a | TATAACTCTAACAGTATCAC | 5-10-5 | 0 | 14758 | 14777 | 913 |
| | | | | | | 14829 | 14848 | |
| | | | | | | 14900 | 14919 | |
| | | | | | | 15019 | 15038 | |
| | | | | | | 15091 | 15110 | |
| | | | | | | 15234 | 15253 | |
| | | | | | | 15306 | 15325 | |
| | | | | | | 15425 | 15444 | |
| | | | | | | 15497 | 15516 | |
| | | | | | | 15627 | 15646 | |
| | | | | | | 15829 | 15848 | |
| | | | | | | 15959 | 15978 | |

TABLE 134-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546838 | n/a | n/a | CTATAACTCTAACAGTATCA | 5-10-5 | 43 | 14759 14830 14901 15020 15092 15235 15307 15426 15498 15628 15830 15960 | 14778 14849 14920 15039 15111 15254 15326 15445 15517 15647 15849 15979 | 914 |
| 546839 | n/a | n/a | CCTATAACTCTAACAGTATC | 5-10-5 | 47 | 14760 14831 14902 15021 15093 15236 15308 15427 15499 15629 15831 15961 | 14779 14850 14921 15040 15112 15255 15327 15446 15518 15648 15850 15980 | 915 |
| 546840 | n/a | n/a | CTGTCCTATAACTCTAACAG | 5-10-5 | 53 | 14764 14835 | 14783 14854 | 916 |
| 546841 | n/a | n/a | CACTGTCCTATAACTCTAAC | 5-10-5 | 38 | 14766 14837 | 14785 14856 | 917 |
| 546842 | n/a | n/a | TCACTGTCCTATAACTCTAA | 5-10-5 | 54 | 14767 14838 | 14786 14857 | 918 |
| 546843 | n/a | n/a | TATCACTGTCCTATAACTCT | 5-10-5 | 52 | 14769 14840 | 14788 14859 | 919 |
| 546844 | n/a | n/a | GTCCTATATCACTGTCCTAT | 5-10-5 | 75 | 14775 14846 15180 15716 | 14794 14865 15199 15735 | 920 |
| 546845 | n/a | n/a | TGTCCTATATCACTGTCCTA | 5-10-5 | 75 | 14776 14847 15181 15717 | 14795 14866 15200 15736 | 921 |
| 546846 | n/a | n/a | CTGTCCTATATCACTGTCCT | 5-10-5 | 95 | 14777 14848 15182 15718 | 14796 14867 15201 15737 | 922 |
| 546847 | n/a | n/a | ACTGTCCTATATCACTGTCC | 5-10-5 | 88 | 14778 14849 15183 15719 | 14797 14868 15202 15738 | 923 |
| 546848 | n/a | n/a | TCACTGTCCTATATCACTGT | 5-10-5 | 86 | 14780 14851 14976 15185 15257 15382 15520 15650 15721 15852 15982 | 14799 14870 14995 15204 15276 15401 15539 15669 15740 15871 16001 | 924 |

TABLE 134-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 547558 | n/a | n/a | CCCCCAGTTCCCATGCAAGG | 5-10-5 | 52 | 6640 | 6659 | 925 |
| 547559 | n/a | n/a | GAGCACAGATCTCTTCAAGT | 5-10-5 | 69 | 6822 | 6841 | 926 |
| 547560 | n/a | n/a | GACGGTCACCCAGCCCTGAC | 5-10-5 | 42 | 7459 | 7478 | 927 |
| 547561 | n/a | n/a | AAGGGAAATTAGAGGCAGGC | 5-10-5 | 57 | 7583 | 7602 | 928 |
| 547562 | n/a | n/a | CTTTCTTGAGACAATCCCTT | 5-10-5 | 59 | 8463 | 8482 | 929 |
| 547563 | n/a | n/a | GTGGGATCAGAGAATGACTA | 5-10-5 | 48 | 9267 | 9286 | 930 |
| 547564 | n/a | n/a | CCCTCTGTCTTAGATGTCCA | 5-10-5 | 94 | 9390 | 9409 | 931 |
| 547565 | n/a | n/a | CTTATCAGTCCCAGTCATGT | 5-10-5 | 63 | 10698 | 10717 | 932 |
| 547566 | n/a | n/a | AAGAGTTGGGATGCGACTCT | 5-10-5 | 76 | 11335 | 11354 | 933 |
| 547567 | n/a | n/a | TCCACTCCTAAGAAGTATGG | 5-10-5 | 60 | 11546 | 11565 | 934 |
| 547568 | n/a | n/a | GCACCCTTTTCATTGAGATT | 5-10-5 | 70 | 12070 | 12089 | 935 |
| 547569 | n/a | n/a | ACTACCATTTGGGTTGGTAG | 5-10-5 | 9 | 12571 | 12590 | 936 |
| 547570 | n/a | n/a | AAGCCCTGTTTGGTTTTTAG | 5-10-5 | 18 | 12900 | 12919 | 937 |
| 547571 | n/a | n/a | AAATGACACCAAAATTGAGT | 5-10-5 | 14 | 13744 | 13763 | 938 |
| 547572 | n/a | n/a | AAATGACACCAAAATTCGCT | 5-10-5 | 40 | 13840 | 13859 | 939 |
| 547573 | n/a | n/a | TAAGCAAGGCCTATGTGTGG | 5-10-5 | 2 | 13880 | 13899 | 940 |
| 547574 | n/a | n/a | ACACGCACAGGTCCCAGGGC | 5-10-5 | 51 | 14314 | 14333 | 941 |
| 547575 | n/a | n/a | GGGAAACTCTTTCCTCGCCC | 5-10-5 | 89 | 14583 | 14602 | 942 |
| 547576 | n/a | n/a | CTAGTTTCCTATAACTGCTG | 5-10-5 | 29 | 14734 | 14753 | 943 |
| 547577 | n/a | n/a | CTAACAGTATCACTGTACTA | 5-10-5 | 79 | 14751 14822 14893 15012 15084 15227 15299 15418 15490 15620 15822 15952 | 14770 14841 14912 15031 15103 15246 15318 15437 15509 15639 15841 15971 | 944 |
| 547578 | n/a | n/a | GTCCTATAACTCTAACAGTA | 5-10-5 | 30 | 14762 14833 | 14781 14852 | 945 |
| 547579 | n/a | n/a | TGTCCTATAACTCTAACAGT | 5-10-5 | 0 | 14763 14834 | 14782 14853 | 946 |
| 547580 | n/a | n/a | ATCACTGTCCTATAACTCTA | 5-10-5 | 61 | 14768 14839 | 14787 14858 | 947 |
| 547581 | n/a | n/a | ATATCACTGTCCTATAACTC | 5-10-5 | 60 | 14770 14841 | 14789 14860 | 948 |
| 547582 | n/a | n/a | TATATCACTGTCCTATAACT | 5-10-5 | 22 | 14771 14842 15176 15712 16160 | 14790 14861 15195 15731 16179 | 949 |

TABLE 134-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 547583 | n/a | n/a | CACTGTCCTATATCACTGTC | 5-10-5 | 80 | 14779 | 14798 | 950 |
| | | | | | | 14850 | 14869 | |
| | | | | | | 15184 | 15203 | |
| | | | | | | 15720 | 15739 | |

TABLE 135

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 531231 | n/a | n/a | TATCACTGTACTAGTTTCCT | 5-10-5 | 85 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |
| 546849 | n/a | n/a | ATCACTGTCCTATATCACTG | 5-10-5 | 93 | 14781 | 14800 | 951 |
| | | | | | | 14852 | 14871 | |
| | | | | | | 14977 | 14996 | |
| | | | | | | 15186 | 15205 | |
| | | | | | | 15258 | 15277 | |
| | | | | | | 15383 | 15402 | |
| | | | | | | 15521 | 15540 | |
| | | | | | | 15651 | 15670 | |
| | | | | | | 15722 | 15741 | |
| | | | | | | 15853 | 15872 | |
| | | | | | | 15983 | 16002 | |
| 546850 | n/a | n/a | TATCACTGTCCTATATCACT | 5-10-5 | 80 | 14782 | 14801 | 952 |
| | | | | | | 14853 | 14872 | |
| | | | | | | 14978 | 14997 | |
| | | | | | | 15116 | 15135 | |
| | | | | | | 15187 | 15206 | |
| | | | | | | 15259 | 15278 | |
| | | | | | | 15384 | 15403 | |
| | | | | | | 15522 | 15541 | |
| | | | | | | 15652 | 15671 | |
| | | | | | | 15723 | 15742 | |
| | | | | | | 15854 | 15873 | |
| | | | | | | 15984 | 16003 | |
| 546851 | n/a | n/a | AGTATCACTGTCCTATATCA | 5-10-5 | 81 | 14784 | 14803 | 953 |
| | | | | | | 14980 | 14999 | |
| | | | | | | 15118 | 15137 | |
| | | | | | | 15386 | 15405 | |
| | | | | | | 15524 | 15543 | |
| | | | | | | 15986 | 16005 | |

TABLE 135-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546852 | n/a | n/a | CAGTATCACTGTCCTATATC | 5-10-5 | 94 | 14785　14981　15119　15387　15525　15987 | 14804　15000　15138　15406　15544　16006 | 954 |
| 546853 | n/a | n/a | ACAGTATCACTGTCCTATAT | 5-10-5 | 86 | 14786　14982　15120　15388　15526　15988 | 14805　15001　15139　15407　15545　16007 | 955 |
| 546854 | n/a | n/a | TAACAGTATCACTGTCCTAT | 5-10-5 | 90 | 14788　14984　15050　15122　15390　15456　15528　15990 | 14807　15003　15069　15141　15409　15475　15547　16009 | 956 |
| 546855 | n/a | n/a | ATAACAGTATCACTGTCCTA | 5-10-5 | 87 | 14789　14985　15051　15123　15391　15457　15529　15991 | 14808　15004　15070　15142　15410　15476　15548　16010 | 957 |
| 546856 | n/a | n/a | AACTATAACAGTATCACTGT | 5-10-5 | 54 | 14793　15055　15127　15160　15461　15533　15566　15696　15898　15995 | 14812　15074　15146　15179　15480　15552　15585　15715　15917　16014 | 958 |
| 546857 | n/a | n/a | TATAACTATAACAGTATCAC | 5-10-5 | 7 | 14796　15058　15130　15163　15464　15536　15569　15699　15770　15998 | 14815　15077　15149　15182　15483　15555　15588　15718　15789　16017 | 959 |
| 546858 | n/a | n/a | CTATAACTATAACAGTATCA | 5-10-5 | 21 | 14797　15059　15131　15164　15465　15537　15570　15700　15771　15999 | 14816　15078　15150　15183　15484　15556　15589　15719　15790　16018 | 960 |
| 546859 | n/a | n/a | TTTCCTATAACTATAACAGT | 5-10-5 | 7 | 14801　15063　15469　15541 | 14820　15082　15488　15560 | 961 |

TABLE 135-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546860 | n/a | n/a | CTAGTTTCCTATAACTATAA | 5-10-5 | 36 | 14805 | 14824 | 962 |
|  |  |  |  |  |  | 14876 | 14895 |  |
|  |  |  |  |  |  | 14935 | 14954 |  |
|  |  |  |  |  |  | 15067 | 15086 |  |
|  |  |  |  |  |  | 15210 | 15229 |  |
|  |  |  |  |  |  | 15282 | 15301 |  |
|  |  |  |  |  |  | 15341 | 15360 |  |
|  |  |  |  |  |  | 15473 | 15492 |  |
|  |  |  |  |  |  | 15545 | 15564 |  |
|  |  |  |  |  |  | 15603 | 15622 |  |
|  |  |  |  |  |  | 15675 | 15694 |  |
| 546861 | n/a | n/a | TAACAATATCACTGTCCTAT | 5-10-5 | 68 | 15746 | 15765 | 963 |
|  |  |  |  |  |  | 15805 | 15824 |  |
|  |  |  |  |  |  | 15877 | 15896 |  |
|  |  |  |  |  |  | 15935 | 15954 |  |
|  |  |  |  |  |  | 14859 | 14878 |  |
|  |  |  |  |  |  | 15193 | 15212 |  |
|  |  |  |  |  |  | 15265 | 15284 |  |
|  |  |  |  |  |  | 15586 | 15605 |  |
|  |  |  |  |  |  | 15658 | 15677 |  |
|  |  |  |  |  |  | 15729 | 15748 |  |
|  |  |  |  |  |  | 15860 | 15879 |  |
|  |  |  |  |  |  | 16086 | 16105 |  |
|  |  |  |  |  |  | 16183 | 16202 |  |
|  |  |  |  |  |  | 16234 | 16253 |  |
| 546862 | n/a | n/a | AACTATAACAATATCACTGT | 5-10-5 | 0 | 14864 | 14883 | 964 |
|  |  |  |  |  |  | 14923 | 14942 |  |
|  |  |  |  |  |  | 15198 | 15217 |  |
|  |  |  |  |  |  | 15270 | 15289 |  |
|  |  |  |  |  |  | 15329 | 15348 |  |
|  |  |  |  |  |  | 15591 | 15610 |  |
|  |  |  |  |  |  | 15663 | 15682 |  |
|  |  |  |  |  |  | 15734 | 15753 |  |
|  |  |  |  |  |  | 15793 | 15812 |  |
|  |  |  |  |  |  | 15865 | 15884 |  |
|  |  |  |  |  |  | 15923 | 15942 |  |
|  |  |  |  |  |  | 16066 | 16085 |  |
|  |  |  |  |  |  | 16091 | 16110 |  |
|  |  |  |  |  |  | 16144 | 16163 |  |
|  |  |  |  |  |  | 16239 | 16258 |  |
| 546863 | n/a | n/a | TAACTATAACAATATCACTG | 5-10-5 | 21 | 14865 | 14884 | 965 |
|  |  |  |  |  |  | 14924 | 14943 |  |
|  |  |  |  |  |  | 15199 | 15218 |  |
|  |  |  |  |  |  | 15271 | 15290 |  |
|  |  |  |  |  |  | 15330 | 15349 |  |
|  |  |  |  |  |  | 15592 | 15611 |  |
|  |  |  |  |  |  | 15664 | 15683 |  |
|  |  |  |  |  |  | 15735 | 15754 |  |
|  |  |  |  |  |  | 15794 | 15813 |  |
|  |  |  |  |  |  | 15866 | 15885 |  |
|  |  |  |  |  |  | 15924 | 15943 |  |
|  |  |  |  |  |  | 16067 | 16086 |  |
|  |  |  |  |  |  | 16092 | 16111 |  |
|  |  |  |  |  |  | 16145 | 16164 |  |
|  |  |  |  |  |  | 16240 | 16259 |  |

TABLE 135-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546864 | n/a | n/a | ATAACTATAACAATATCACT | 5-10-5 | 0 | 14866 | 14885 | 966 |
| | | | | | | 14925 | 14944 | |
| | | | | | | 15200 | 15219 | |
| | | | | | | 15272 | 15291 | |
| | | | | | | 15331 | 15350 | |
| | | | | | | 15593 | 15612 | |
| | | | | | | 15665 | 15684 | |
| | | | | | | 15736 | 15755 | |
| | | | | | | 15795 | 15814 | |
| | | | | | | 15867 | 15886 | |
| | | | | | | 15925 | 15944 | |
| | | | | | | 16068 | 16087 | |
| | | | | | | 16093 | 16112 | |
| | | | | | | 16146 | 16165 | |
| | | | | | | 16241 | 16260 | |
| 546865 | n/a | n/a | TATAACTATAACAATATCAC | 5-10-5 | 0 | 14867 | 14886 | 967 |
| | | | | | | 14926 | 14945 | |
| | | | | | | 15201 | 15220 | |
| | | | | | | 15273 | 15292 | |
| | | | | | | 15332 | 15351 | |
| | | | | | | 15594 | 15613 | |
| | | | | | | 15666 | 15685 | |
| | | | | | | 15737 | 15756 | |
| | | | | | | 15796 | 15815 | |
| | | | | | | 15868 | 15887 | |
| | | | | | | 15926 | 15945 | |
| | | | | | | 16069 | 16088 | |
| | | | | | | 16094 | 16113 | |
| | | | | | | 16147 | 16166 | |
| | | | | | | 16242 | 16261 | |
| 546866 | n/a | n/a | GTTTCCTATAACTATAACAA | 5-10-5 | 35 | 14873 | 14892 | 968 |
| | | | | | | 14932 | 14951 | |
| | | | | | | 15207 | 15226 | |
| | | | | | | 15279 | 15298 | |
| | | | | | | 15338 | 15357 | |
| | | | | | | 15600 | 15619 | |
| | | | | | | 15672 | 15691 | |
| | | | | | | 15743 | 15762 | |
| | | | | | | 15802 | 15821 | |
| | | | | | | 15874 | 15893 | |
| | | | | | | 15932 | 15951 | |
| 546867 | n/a | n/a | ACCTATAACTCTAACAGTAT | 5-10-5 | 40 | 14903 | 14922 | 969 |
| | | | | | | 15022 | 15041 | |
| | | | | | | 15094 | 15113 | |
| | | | | | | 15237 | 15256 | |
| | | | | | | 15309 | 15328 | |
| | | | | | | 15428 | 15447 | |
| | | | | | | 15500 | 15519 | |
| | | | | | | 15630 | 15649 | |
| | | | | | | 15832 | 15851 | |
| | | | | | | 15962 | 15981 | |
| 546868 | n/a | n/a | TACCTATAACTCTAACAGTA | 5-10-5 | 51 | 14904 | 14923 | 970 |
| | | | | | | 15023 | 15042 | |
| | | | | | | 15095 | 15114 | |
| | | | | | | 15238 | 15257 | |
| | | | | | | 15310 | 15329 | |
| | | | | | | 15429 | 15448 | |
| | | | | | | 15501 | 15520 | |
| | | | | | | 15631 | 15650 | |
| | | | | | | 15833 | 15852 | |
| | | | | | | 15963 | 15982 | |

TABLE 135-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546869 | n/a | n/a | TGTACCTATAACTCTAACAG | 5-10-5 | 53 | 14906<br>15025<br>15240<br>15312<br>15431<br>15503<br>15633<br>15835<br>15965 | 14925<br>15044<br>15259<br>15331<br>15450<br>15522<br>15652<br>15854<br>15984 | 971 |
| 546870 | n/a | n/a | CTGTACCTATAACTCTAACA | 5-10-5 | 87 | 14907<br>15026<br>15241<br>15313<br>15432<br>15504<br>15634<br>15836<br>15966 | 14926<br>15045<br>15260<br>15332<br>15451<br>15523<br>15653<br>15855<br>15985 | 972 |
| 546871 | n/a | n/a | ACTGTACCTATAACTCTAAC | 5-10-5 | 73 | 14908<br>15027<br>15242<br>15314<br>15433<br>15505<br>15635<br>15837<br>15967 | 14927<br>15046<br>15261<br>15333<br>15452<br>15524<br>15654<br>15856<br>15986 | 973 |
| 546872 | n/a | n/a | CACTGTACCTATAACTCTAA | 5-10-5 | 87 | 14909<br>15028<br>15243<br>15315<br>15434<br>15506<br>15636<br>15838<br>15968 | 14928<br>15047<br>15262<br>15334<br>15453<br>15525<br>15655<br>15857<br>15987 | 974 |
| 546873 | n/a | n/a | CAATATCACTGTACCTATAA | 5-10-5 | 34 | 14915<br>15321<br>15785 | 14934<br>15340<br>15804 | 975 |
| 546874 | n/a | n/a | ATAACAATATCACTGTACCT | 5-10-5 | 68 | 14919<br>15325<br>15789<br>16062<br>16140 | 14938<br>15344<br>15808<br>16081<br>16159 | 976 |
| 546875 | n/a | n/a | ACTATAACAATATCACTGTA | 5-10-5 | 33 | 14922<br>15328<br>15792<br>16065<br>16143 | 14941<br>15347<br>15811<br>16084<br>16162 | 977 |
| 546876 | n/a | n/a | GTCCTATATCACTGTACCTG | 5-10-5 | 87 | 14971 | 14990 | 978 |
| 546877 | n/a | n/a | CACTGTCCTATATCACTGTA | 5-10-5 | 88 | 14975<br>15256<br>15381<br>15519<br>15649<br>15851<br>15981 | 14994<br>15275<br>15400<br>15538<br>15668<br>15870<br>16000 | 979 |
| 546878 | n/a | n/a | CCTATAACAGTATCACTGTC | 5-10-5 | 81 | 14988<br>15394 | 15007<br>15413 | 980 |
| 546879 | n/a | n/a | TTTCCTATAACAGTATCACT | 5-10-5 | 42 | 14991<br>15397 | 15010<br>15416 | 981 |

TABLE 135-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 546880 | n/a | n/a | GTTTCCTATAACAGTATCAC | 5-10-5 | 41 | 14992<br>15398 | 15011<br>15417 | 982 |
| 546881 | n/a | n/a | AGTTTCCTATAACAGTATCA | 5-10-5 | 49 | 14993<br>15399 | 15012<br>15418 | 983 |
| 546882 | n/a | n/a | TAGTTTCCTATAACAGTATC | 5-10-5 | 24 | 14994<br>15400 | 15013<br>15419 | 984 |
| 546883 | n/a | n/a | CTAGTTTCCTATAACAGTAT | 5-10-5 | 19 | 14995<br>15401 | 15014<br>15420 | 985 |
| 546884 | n/a | n/a | ACTAGTTTCCTATAACAGTA | 5-10-5 | 6 | 14996<br>15402 | 15015<br>15421 | 986 |
| 547584 | n/a | n/a | GTATCACTGTCCTATATCAC | 5-10-5 | 85 | 14783<br>14979<br>15117<br>15385<br>15523<br>15985 | 14802<br>14998<br>15136<br>15404<br>15542<br>16004 | 987 |
| 547585 | n/a | n/a | AACAGTATCACTGTCCTATA | 5-10-5 | 85 | 14787<br>14983<br>15121<br>15389<br>15527<br>15989 | 14806<br>15002<br>15140<br>15408<br>15546<br>16008 | 988 |
| 547586 | n/a | n/a | TATAACAGTATCACTGTCCT | 5-10-5 | 82 | 14790<br>14986<br>15052<br>15124<br>15392<br>15458<br>15530<br>15992 | 14809<br>15005<br>15071<br>15143<br>15411<br>15477<br>15549<br>16011 | 989 |
| 547587 | n/a | n/a | CTATAACAGTATCACTGTCC | 5-10-5 | 96 | 14791<br>14987<br>15053<br>15125<br>15393<br>15459<br>15531<br>15993 | 14810<br>15006<br>15072<br>15144<br>15412<br>15478<br>15550<br>16012 | 990 |
| 547588 | n/a | n/a | ACTATAACAGTATCACTGTC | 5-10-5 | 83 | 14792<br>15054<br>15126<br>15460<br>15532<br>15994 | 14811<br>15073<br>15145<br>15479<br>15551<br>16013 | 991 |
| 547589 | n/a | n/a | TAACTATAACAGTATCACTG | 5-10-5 | 36 | 14794<br>15056<br>15128<br>15161<br>15462<br>15534<br>15567<br>15697<br>15996 | 14813<br>15075<br>15147<br>15180<br>15481<br>15553<br>15586<br>15716<br>16015 | 992 |
| 547590 | n/a | n/a | ATAACTATAACAGTATCACT | 5-10-5 | 0 | 14795<br>15057<br>15129<br>15162<br>15463<br>15535<br>15568<br>15698<br>15997 | 14814<br>15076<br>15148<br>15181<br>15482<br>15554<br>15587<br>15717<br>16016 | 993 |

TABLE 135-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 547591 | n/a | n/a | CCTATAACTATAACAGTATC | 5-10-5 | 23 | 14798 | 14817 | 994 |
| | | | | | | 15060 | 15079 | |
| | | | | | | 15165 | 15184 | |
| | | | | | | 15466 | 15485 | |
| | | | | | | 15538 | 15557 | |
| | | | | | | 15571 | 15590 | |
| | | | | | | 15701 | 15720 | |
| | | | | | | 15772 | 15791 | |
| | | | | | | 16000 | 16019 | |
| 547592 | n/a | n/a | TCCTATAACTATAACAGTAT | 5-10-5 | 27 | 14799 | 14818 | 995 |
| | | | | | | 15061 | 15080 | |
| | | | | | | 15166 | 15185 | |
| | | | | | | 15467 | 15486 | |
| | | | | | | 15539 | 15558 | |
| | | | | | | 15572 | 15591 | |
| | | | | | | 15702 | 15721 | |
| | | | | | | 16001 | 16020 | |
| 547593 | n/a | n/a | TTCCTATAACTATAACAGTA | 5-10-5 | 29 | 14800 | 14819 | 996 |
| | | | | | | 15062 | 15081 | |
| | | | | | | 15468 | 15487 | |
| | | | | | | 15540 | 15559 | |
| 547594 | n/a | n/a | GTTTCCTATAACTATAACAG | 5-10-5 | 19 | 14802 | 14821 | 997 |
| | | | | | | 15064 | 15083 | |
| | | | | | | 15470 | 15489 | |
| | | | | | | 15542 | 15561 | |
| 547595 | n/a | n/a | ACTAGTTTCCTATAACTATA | 5-10-5 | 21 | 14806 | 14825 | 998 |
| | | | | | | 14877 | 14896 | |
| | | | | | | 14936 | 14955 | |
| | | | | | | 15068 | 15087 | |
| | | | | | | 15211 | 15230 | |
| | | | | | | 15283 | 15302 | |
| | | | | | | 15342 | 15361 | |
| | | | | | | 15474 | 15493 | |
| | | | | | | 15546 | 15565 | |
| | | | | | | 15604 | 15623 | |
| | | | | | | 15676 | 15695 | |
| | | | | | | 15747 | 15766 | |
| | | | | | | 15806 | 15825 | |
| | | | | | | 15878 | 15897 | |
| | | | | | | 15936 | 15955 | |
| 547596 | n/a | n/a | TACTAGTTTCCTATAACTAT | 5-10-5 | 14 | 14807 | 14826 | 999 |
| | | | | | | 14878 | 14897 | |
| | | | | | | 14937 | 14956 | |
| | | | | | | 15069 | 15088 | |
| | | | | | | 15212 | 15231 | |
| | | | | | | 15284 | 15303 | |
| | | | | | | 15343 | 15362 | |
| | | | | | | 15475 | 15494 | |
| | | | | | | 15547 | 15566 | |
| | | | | | | 15605 | 15624 | |
| | | | | | | 15677 | 15696 | |
| | | | | | | 15748 | 15767 | |
| | | | | | | 15807 | 15826 | |
| | | | | | | 15879 | 15898 | |
| | | | | | | 15937 | 15956 | |
| 547597 | n/a | n/a | CAATATCACTGTCCTATATC | 5-10-5 | 29 | 14856 | 14875 | 1000 |
| | | | | | | 15190 | 15209 | |
| | | | | | | 15262 | 15281 | |
| | | | | | | 15655 | 15674 | |
| | | | | | | 15726 | 15745 | |
| | | | | | | 15857 | 15876 | |

TABLE 135-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 547598 | n/a | n/a | ACTATAACAATATCACTGTC | 5-10-5 | 59 | 14863 | 14882 | 1001 |
|  |  |  |  |  |  | 15197 | 15216 |  |
|  |  |  |  |  |  | 15269 | 15288 |  |
|  |  |  |  |  |  | 15590 | 15609 |  |
|  |  |  |  |  |  | 15662 | 15681 |  |
|  |  |  |  |  |  | 15733 | 15752 |  |
|  |  |  |  |  |  | 15864 | 15883 |  |
|  |  |  |  |  |  | 15922 | 15941 |  |
|  |  |  |  |  |  | 16090 | 16109 |  |
|  |  |  |  |  |  | 16238 | 16257 |  |
| 547599 | n/a | n/a | TTCCTATAACTATAACAATA | 5-10-5 | 4 | 14871 | 14890 | 1002 |
|  |  |  |  |  |  | 14930 | 14949 |  |
|  |  |  |  |  |  | 15205 | 15224 |  |
|  |  |  |  |  |  | 15277 | 15296 |  |
|  |  |  |  |  |  | 15336 | 15355 |  |
|  |  |  |  |  |  | 15598 | 15617 |  |
|  |  |  |  |  |  | 15670 | 15689 |  |
|  |  |  |  |  |  | 15741 | 15760 |  |
|  |  |  |  |  |  | 15800 | 15819 |  |
|  |  |  |  |  |  | 15872 | 15891 |  |
|  |  |  |  |  |  | 15930 | 15949 |  |
| 547600 | n/a | n/a | TTTCCTATAACTATAACAAT | 5-10-5 | 26 | 14872 | 14891 | 1003 |
|  |  |  |  |  |  | 14931 | 14950 |  |
|  |  |  |  |  |  | 15206 | 15225 |  |
|  |  |  |  |  |  | 15278 | 15297 |  |
|  |  |  |  |  |  | 15337 | 15356 |  |
|  |  |  |  |  |  | 15599 | 15618 |  |
|  |  |  |  |  |  | 15671 | 15690 |  |
|  |  |  |  |  |  | 15742 | 15761 |  |
|  |  |  |  |  |  | 15801 | 15820 |  |
|  |  |  |  |  |  | 15873 | 15892 |  |
|  |  |  |  |  |  | 15931 | 15950 |  |
| 547601 | n/a | n/a | GTACCTATAACTCTAACAGT | 5-10-5 | 75 | 14905 | 14924 | 1004 |
|  |  |  |  |  |  | 15024 | 15043 |  |
|  |  |  |  |  |  | 15239 | 15258 |  |
|  |  |  |  |  |  | 15311 | 15330 |  |
|  |  |  |  |  |  | 15430 | 15449 |  |
|  |  |  |  |  |  | 15502 | 15521 |  |
|  |  |  |  |  |  | 15632 | 15651 |  |
|  |  |  |  |  |  | 15834 | 15853 |  |
|  |  |  |  |  |  | 15964 | 15983 |  |
| 547602 | n/a | n/a | TCACTGTACCTATAACTCTA | 5-10-5 | 93 | 14910 | 14929 | 1005 |
|  |  |  |  |  |  | 15029 | 15048 |  |
|  |  |  |  |  |  | 15244 | 15263 |  |
|  |  |  |  |  |  | 15316 | 15335 |  |
|  |  |  |  |  |  | 15435 | 15454 |  |
|  |  |  |  |  |  | 15507 | 15526 |  |
|  |  |  |  |  |  | 15637 | 15656 |  |
|  |  |  |  |  |  | 15839 | 15858 |  |
|  |  |  |  |  |  | 15969 | 15988 |  |
| 547603 | n/a | n/a | TATCACTGTACCTATAACTC | 5-10-5 | 41 | 14912 | 14931 | 1006 |
|  |  |  |  |  |  | 15246 | 15265 |  |
|  |  |  |  |  |  | 15318 | 15337 |  |
|  |  |  |  |  |  | 15509 | 15528 |  |
|  |  |  |  |  |  | 15639 | 15658 |  |
|  |  |  |  |  |  | 15841 | 15860 |  |
|  |  |  |  |  |  | 15971 | 15990 |  |
| 547604 | n/a | n/a | ATATCACTGTACCTATAACT | 5-10-5 | 0 | 14913 | 14932 | 1007 |
|  |  |  |  |  |  | 15247 | 15266 |  |
|  |  |  |  |  |  | 15319 | 15338 |  |
|  |  |  |  |  |  | 15510 | 15529 |  |
|  |  |  |  |  |  | 15640 | 15659 |  |
|  |  |  |  |  |  | 15783 | 15802 |  |
|  |  |  |  |  |  | 15842 | 15861 |  |
|  |  |  |  |  |  | 15972 | 15991 |  |

TABLE 135-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 547605 | n/a | n/a | ACAATATCACTGTACCTATA | 5-10-5 | 43 | 14916 15322 15786 16137 | 14935 15341 15805 16156 | 1008 |
| 547606 | n/a | n/a | AACAATATCACTGTACCTAT | 5-10-5 | 43 | 14917 15323 15787 16138 | 14936 15342 15806 16157 | 1009 |
| 547607 | n/a | n/a | TAACAATATCACTGTACCTA | 5-10-5 | 49 | 14918 15324 15788 16139 | 14937 15343 15807 16158 | 1010 |
| 547608 | n/a | n/a | TATAACAATATCACTGTACC | 5-10-5 | 35 | 14920 15326 15790 16063 16141 | 14939 15345 15809 16082 16160 | 1011 |
| 547609 | n/a | n/a | CTATAACAATATCACTGTAC | 5-10-5 | 23 | 14921 15327 15791 16064 16142 | 14940 15346 15810 16083 16161 | 1012 |
| 547610 | n/a | n/a | TGTAACAGTATCACTGTACT | 5-10-5 | 45 | 14953 | 14972 | 1013 |
| 547611 | n/a | n/a | CTGTAACAGTATCACTGTAC | 5-10-5 | 71 | 14954 | 14973 | 1014 |
| 547612 | n/a | n/a | CCTGTAACAGTATCACTGTA | 5-10-5 | 68 | 14955 | 14974 | 1015 |
| 547613 | n/a | n/a | CTATATCACTGTACCTGTAA | 5-10-5 | 39 | 14968 | 14987 | 1016 |
| 547614 | n/a | n/a | CCTATATCACTGTACCTGTA | 5-10-5 | 81 | 14969 | 14988 | 1017 |
| 547615 | n/a | n/a | TCCTATATCACTGTACCTGT | 5-10-5 | 84 | 14970 | 14989 | 1018 |
| 547616 | n/a | n/a | TGTCCTATATCACTGTACCT | 5-10-5 | 86 | 14972 15253 15378 15516 15646 15848 15978 | 14991 15272 15397 15535 15665 15867 15997 | 1019 |
| 547617 | n/a | n/a | CTGTCCTATATCACTGTACC | 5-10-5 | 91 | 14973 15254 15379 15517 15647 15849 15979 | 14992 15273 15398 15536 15666 15868 15998 | 1020 |
| 547618 | n/a | n/a | ACTGTCCTATATCACTGTAC | 5-10-5 | 87 | 14974 15255 15380 15518 15648 15850 15980 | 14993 15274 15399 15537 15667 15869 15999 | 1021 |
| 547619 | n/a | n/a | TCCTATAACAGTATCACTGT | 5-10-5 | 70 | 14989 15395 | 15008 15414 | 1022 |
| 547620 | n/a | n/a | TTCCTATAACAGTATCACTG | 5-10-5 | 65 | 14990 15396 | 15009 15415 | 1023 |
| 547621 | n/a | n/a | TACTAGTTTCCTATAACAGT | 5-10-5 | 12 | 14997 15403 | 15016 15422 | 1024 |

TABLE 135-continued

| ISIS NO | SEQ ID NO: 1 Start Site | SEQ ID NO: 1 Stop Site | Sequence | Motif | % inhibition | SEQ ID NO. 10 Start Site | SEQ ID NO. 10 Stop Site | SEQ ID NO: |
|---|---|---|---|---|---|---|---|---|
| 547622 | n/a | n/a | GTCACTGTACCTATAACTCT | 5-10-5 | 88 | 15030 15436 | 15049 15455 | 1025 |
| 547623 | n/a | n/a | TGTCACTGTACCTATAACTC | 5-10-5 | 81 | 15031 15437 | 15050 15456 | 1026 |
| 547624 | n/a | n/a | ATGTCACTGTACCTATAACT | 5-10-5 | 64 | 15032 15438 | 15051 15457 | 1027 |

TABLE 136

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 93 | 5-10-5 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 546885 | n/a | n/a | TATGTCACTGTACCTATAAC | 46 | 5-10-5 | 15033 15439 | 15052 15458 | 1028 |
| 546886 | n/a | n/a | CTATGTCACTGTACCTATAA | 80 | 5-10-5 | 15034 15440 | 15053 15459 | 1029 |
| 546887 | n/a | n/a | CCTATGTCACTGTACCTATA | 82 | 5-10-5 | 15035 15441 | 15054 15460 | 1030 |
| 546888 | n/a | n/a | TCCTATGTCACTGTACCTAT | 78 | 5-10-5 | 15036 15442 | 15055 15461 | 1031 |
| 546889 | n/a | n/a | GTCCTATGTCACTGTACCTA | 93 | 5-10-5 | 15037 15443 | 15056 15462 | 1032 |
| 546890 | n/a | n/a | TGTCCTATGTCACTGTACCT | 78 | 5-10-5 | 15038 15444 | 15057 15463 | 1033 |
| 546891 | n/a | n/a | CTGTCCTATGTCACTGTACC | 81 | 5-10-5 | 15039 15445 | 15058 15464 | 1034 |
| 546892 | n/a | n/a | ACTGTCCTATGTCACTGTAC | 82 | 5-10-5 | 15040 15446 | 15059 15465 | 1035 |
| 546893 | n/a | n/a | CACTGTCCTATGTCACTGTA | 70 | 5-10-5 | 15041 15447 | 15060 15466 | 1036 |
| 546894 | n/a | n/a | TCACTGTCCTATGTCACTGT | 91 | 5-10-5 | 15042 15448 | 15061 15467 | 1037 |
| 546895 | n/a | n/a | TATCACTGTCCTATGTCACT | 77 | 5-10-5 | 15044 15450 | 15063 15469 | 1038 |

TABLE 136-continued

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| 546896 | n/a | n/a | GTATCACTGTCCTATGTCAC | 75 | 5-10-5 | 15045 15451 | 15064 15470 | 1039 |
| 546897 | n/a | n/a | AGTATCACTGTCCTATGTCA | 90 | 5-10-5 | 15046 15452 | 15065 15471 | 1040 |
| 546898 | n/a | n/a | AACAGTATCACTGTCCTATG | 91 | 5-10-5 | 15049 15455 | 15068 15474 | 1041 |
| 546899 | n/a | n/a | CTACCTATAACTCTAACAGT | 27 | 5-10-5 | 15096 | 15115 | 1042 |
| 546901 | n/a | n/a | ACTGTCCTATAACTATAACA | 56 | 5-10-5 | 15170 15576 15706 16005 16076 16101 16154 | 15189 15595 15725 16024 16095 16120 16173 | 1043 |
| 546902 | n/a | n/a | CACTGTCCTATAACTATAAC | 71 | 5-10-5 | 15171 15577 15707 16006 16077 16102 16155 | 15190 15596 15726 16025 16096 16121 16174 | 1044 |
| 546903 | n/a | n/a | CCTATATCACTGTACCTATA | 91 | 5-10-5 | 15250 15375 15513 15643 15845 15975 | 15269 15394 15532 15662 15864 15994 | 1045 |
| 546904 | n/a | n/a | TCCTATATCACTGTACCTAT | 80 | 5-10-5 | 15251 15376 15514 15644 15846 15976 | 15270 15395 15533 15663 15865 15995 | 1046 |
| 546905 | n/a | n/a | TACCTATAACAGTATCACTG | 65 | 5-10-5 | 15363 | 15382 | 1047 |
| 546907 | n/a | n/a | ATAACTATAACAGTATCACC | 37 | 5-10-5 | 15769 | 15788 | 1048 |
| 546908 | n/a | n/a | TCACTGTACCTATAACTATA | 77 | 5-10-5 | 15780 16252 | 15799 16271 | 1049 |
| 546909 | n/a | n/a | AACAATATCACTGTACCTTT | 44 | 5-10-5 | 16060 | 16079 | 1050 |
| 546910 | n/a | n/a | TAACAATATCACTGTACCTT | 82 | 5-10-5 | 16061 | 16080 | 1051 |
| 546911 | n/a | n/a | GTCCTATAACTATAACAATA | 52 | 5-10-5 | 16073 16098 16151 | 16092 16117 16170 | 1052 |
| 547625 | n/a | n/a | CAGTATCACTGTCCTATGTC | 79 | 5-10-5 | 15047 15453 | 15066 15472 | 1053 |
| 547626 | n/a | n/a | ACAGTATCACTGTCCTATGT | 91 | 5-10-5 | 15048 15454 | 15067 15473 | 1054 |
| 547627 | n/a | n/a | TCTACCTATAACTCTAACAG | 71 | 5-10-5 | 15097 | 15116 | 1055 |
| 547628 | n/a | n/a | CTCTACCTATAACTCTAACA | 34 | 5-10-5 | 15098 | 15117 | 1056 |
| 547629 | n/a | n/a | ACTCTACCTATAACTCTAAC | 0 | 5-10-5 | 15099 | 15118 | 1057 |
| 547630 | n/a | n/a | ACTGTCCTATATCACTCTAC | 76 | 5-10-5 | 15112 | 15131 | 1058 |
| 547631 | n/a | n/a | CACTGTCCTATATCACTCTA | 85 | 5-10-5 | 15113 | 15132 | 1059 |
| 547632 | n/a | n/a | TCACTGTCCTATATCACTCT | 87 | 5-10-5 | 15114 | 15133 | 1060 |

TABLE 136-continued

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| 547633 | n/a | n/a | ATCACTGTCCTATATCACTC | 87 | 5-10-5 | 15115 | 15134 | 1061 |
| 547634 | n/a | n/a | ATCACTGTACTAGTTTTCTA | 72 | 5-10-5 | 15148 | 15167 | 1062 |
| 547635 | n/a | n/a | TATCACTGTACTAGTTTTCT | 53 | 5-10-5 | 15149 | 15168 | 1063 |
| 547636 | n/a | n/a | GTATCACTGTACTAGTTTTC | 86 | 5-10-5 | 15150 | 15169 | 1064 |
| 547637 | n/a | n/a | AGTATCACTGTACTAGTTTT | 88 | 5-10-5 | 15151 | 15170 | 1065 |
| 547638 | n/a | n/a | ATAACAGTATCACTGTACTA | 87 | 5-10-5 | 15156 15358 15562 15692 15894 | 15175 15377 15581 15711 15913 | 1066 |
| 547639 | n/a | n/a | GTCCTATAACTATAACAGTA | 72 | 5-10-5 | 15167 15573 15703 16002 | 15186 15592 15722 16021 | 1067 |
| 547640 | n/a | n/a | TGTCCTATAACTATAACAGT | 13 | 5-10-5 | 15168 15574 15704 16003 | 15187 15593 15723 16022 | 1068 |
| 547641 | n/a | n/a | CTGTCCTATAACTATAACAG | 43 | 5-10-5 | 15169 15575 15705 16004 | 15188 15594 15724 16023 | 1069 |
| 547642 | n/a | n/a | TCACTGTCCTATAACTATAA | 72 | 5-10-5 | 15172 15578 15708 16007 16078 16103 16156 | 15191 15597 15727 16026 16097 16122 16175 | 1070 |
| 547643 | n/a | n/a | ATCACTGTCCTATAACTATA | 72 | 5-10-5 | 15173 15579 15709 16008 16079 16104 16157 16176 | 15192 15598 15728 16027 16098 16123 16176 16195 | 1071 |
| 547644 | n/a | n/a | TATCACTGTCCTATAACTAT | 51 | 5-10-5 | 15174 15580 15710 16009 16080 16158 16177 16228 | 15193 15599 15729 16028 16099 16177 16196 16247 | 1072 |
| 547645 | n/a | n/a | ATATCACTGTCCTATAACTA | 60 | 5-10-5 | 15175 15581 15711 16010 16081 16159 16178 16229 | 15194 15600 15730 16029 16100 16178 16197 16248 | 1073 |
| 547646 | n/a | n/a | CTATATCACTGTACCTATAA | 23 | 5-10-5 | 15249 15374 15512 15642 15844 15974 | 15268 15393 15531 15661 15863 15993 | 1074 |

TABLE 136-continued

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| 547647 | n/a | n/a | GTCCTATATCACTGTACCTA | 92 | 5-10-5 | 15252 15377 15515 15645 15847 15977 | 15271 15396 15534 15664 15866 15996 | 1075 |
| 547648 | n/a | n/a | CCTATAACAGTATCACTGTA | 83 | 5-10-5 | 15361 | 15380 | 1076 |
| 547649 | n/a | n/a | ACCTATAACAGTATCACTGT | 73 | 5-10-5 | 15362 | 15381 | 1077 |
| 547650 | n/a | n/a | GTACCTATAACAGTATCACT | 32 | 5-10-5 | 15364 | 15383 | 1078 |
| 547651 | n/a | n/a | TGTACCTATAACAGTATCAC | 48 | 5-10-5 | 15365 | 15384 | 1079 |
| 547652 | n/a | n/a | TCACTGTACCTATAACAGTA | 59 | 5-10-5 | 15369 | 15388 | 1080 |
| 547653 | n/a | n/a | ATCACTGTACCTATAACAGT | 57 | 5-10-5 | 15370 | 15389 | 1081 |
| 547654 | n/a | n/a | TATCACTGTACCTATAACAG | 53 | 5-10-5 | 15371 | 15390 | 1082 |
| 547655 | n/a | n/a | AATATCACTGTCCTATAACT | 37 | 5-10-5 | 15582 16011 16082 16179 16230 | 15601 16030 16101 16198 16249 | 1083 |
| 547656 | n/a | n/a | CAATATCACTGTCCTATAAC | 42 | 5-10-5 | 15583 16083 16180 16231 | 15602 16102 16199 16250 | 1084 |
| 547657 | n/a | n/a | ACAATATCACTGTCCTATAA | 43 | 5-10-5 | 15584 16084 16181 16232 | 15603 16103 16200 16251 | 1085 |
| 547658 | n/a | n/a | CGTACTAGTTTCCTATAACT | 68 | 5-10-5 | 15750 | 15769 | 1086 |
| 547659 | n/a | n/a | ACTATAACAGTATCACCGTA | 80 | 5-10-5 | 15766 | 15785 | 1087 |
| 547660 | n/a | n/a | AACTATAACAGTATCACCGT | 68 | 5-10-5 | 15767 | 15786 | 1088 |
| 547661 | n/a | n/a | TAACTATAACAGTATCACCG | 80 | 5-10-5 | 15768 | 15787 | 1089 |
| 547662 | n/a | n/a | ACCTATAACTATAACAGTAT | 0 | 5-10-5 | 15773 | 15792 | 1090 |
| 547663 | n/a | n/a | TACCTATAACTATAACAGTA | 10 | 5-10-5 | 15774 | 15793 | 1091 |
| 547664 | n/a | n/a | GTACCTATAACTATAACAGT | 2 | 5-10-5 | 15775 | 15794 | 1092 |
| 547665 | n/a | n/a | TGTACCTATAACTATAACAG | 10 | 5-10-5 | 15776 | 15795 | 1093 |
| 547666 | n/a | n/a | ATCACTGTACCTATAACTAT | 71 | 5-10-5 | 15781 16253 | 15800 16272 | 1094 |
| 547667 | n/a | n/a | TATCACTGTACCTATAACTA | 55 | 5-10-5 | 15782 | 15801 | 1095 |
| 547668 | n/a | n/a | CAACTATAACAGTATCACTG | 44 | 5-10-5 | 15899 | 15918 | 1096 |
| 547669 | n/a | n/a | ACAACTATAACAGTATCACT | 0 | 5-10-5 | 15900 | 15919 | 1097 |
| 547670 | n/a | n/a | TACAACTATAACAGTATCAC | 0 | 5-10-5 | 15901 | 15920 | 1098 |
| 547671 | n/a | n/a | CTACAACTATAACAGTATCA | 0 | 5-10-5 | 15902 | 15921 | 1099 |
| 547672 | n/a | n/a | CAATATCACTGTCCTACAAC | 36 | 5-10-5 | 15915 | 15934 | 1100 |
| 547673 | n/a | n/a | GAATATCACTGTCCTATAAC | 21 | 5-10-5 | 16012 | 16031 | 1101 |
| 547674 | n/a | n/a | ACAATATCACTGTACCTTTA | 53 | 5-10-5 | 16059 | 16078 | 1102 |

TABLE 136-continued

| ISIS NO | SEQ ID NO: 1 Start Site | SEQ ID NO: 1 Stop Site | Sequence | % inhibition | Motif | SEQ ID NO: 10 Start Site | SEQ ID NO: 10 Stop Site | SEQ ID NO |
|---|---|---|---|---|---|---|---|---|
| 547675 | n/a | n/a | TGTCCTATAACTATAACAAT | 10 | 5-10-5 | 16074 16099 16152 | 16093 16118 16171 | 1103 |
| 547676 | n/a | n/a | CTGTCCTATAACTATAACAA | 41 | 5-10-5 | 16075 16100 16153 | 16094 16119 16172 | 1104 |

TABLE 137

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 93 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 546529 | n/a | n/a | GCACCTGGCAGAACAGTACC | 5-10-5 | 65 | 26419 | 26438 | 1105 |
| 546578 | n/a | n/a | GACAGTGGGCCAGAGCCTTG | 5-10-5 | 73 | 26686 | 26705 | 1106 |
| 546912 | n/a | n/a | ACATCACTGTCCTATAACTA | 5-10-5 | 26 | 16106 | 16125 | 1107 |
| 546913 | n/a | n/a | GTACCTATATCACTGTAACT | 5-10-5 | 38 | 16126 | 16145 | 1108 |
| 546914 | n/a | n/a | ATATCACTGTACCTATATCA | 5-10-5 | 52 | 16134 | 16153 | 1109 |
| 546915 | n/a | n/a | TCACTGTCCTATAACTATAT | 5-10-5 | 39 | 16175 | 16194 | 1110 |
| 546916 | n/a | n/a | CGTCACTGTACCTATAACTG | 5-10-5 | 92 | 16203 | 16222 | 1111 |
| 546917 | n/a | n/a | ATCACTGTCCTATAACTATT | 5-10-5 | 63 | 16227 | 16246 | 1112 |
| 546918 | n/a | n/a | AACATCACTGTACCTATAAC | 5-10-5 | 14 | 16256 | 16275 | 1113 |
| 546926 | n/a | n/a | GCCATCCAGGGTGCTCTCCC | 5-10-5 | 81 | 16839 | 16858 | 1114 |
| 546931 | n/a | n/a | GCCCCCGGAGCACCTTCACT | 5-10-5 | 58 | 17205 | 17224 | 1115 |
| 546935 | n/a | n/a | CGTGGTTAGCCTGACATCTC | 5-10-5 | 86 | 17412 | 17431 | 1116 |
| 546939 | n/a | n/a | GCCATCTGGTTAGCCTCCGA | 5-10-5 | 89 | 17664 | 17683 | 1117 |
| 546942 | n/a | n/a | TACACTGAACCCCCTTAGGC | 5-10-5 | 56 | 18570 | 18589 | 1118 |
| 546943 | n/a | n/a | CAGTTTGGCCTTTCCATCTC | 5-10-5 | 54 | 18819 | 18838 | 1119 |
| 546944 | n/a | n/a | GCCACTAACCCACCTCTTAA | 5-10-5 | 42 | 19140 | 19159 | 1120 |
| 546946 | n/a | n/a | ACTCCCATCTACTCCCCCAT | 5-10-5 | 41 | 19291 | 19310 | 1121 |
| 546954 | n/a | n/a | CTGCTGATTGTGTCTGGCTC | 5-10-5 | 71 | 20235 | 20254 | 1122 |

TABLE 137-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 546955 | n/a | n/a | ACAAGGCTTCGAGGACAGCC | 5-10-5 | 49 | 20339 | 20358 | 1123 |
| 546964 | n/a | n/a | GCGATTCCTTGCCTCTGCTG | 5-10-5 | 53 | 21550 | 21569 | 1124 |
| 546967 | n/a | n/a | CACCGCGCGAATGCCTGCCT | 5-10-5 | 93 | 22657 | 22676 | 1125 |
| 546969 | n/a | n/a | ATCCAACCTCTCTCCCTATC | 5-10-5 | 53 | 22901 | 22920 | 1126 |
| 546970 | n/a | n/a | GCCCAAGCCTACATGCATAC | 5-10-5 | 61 | 23426 | 23445 | 1127 |
| 546975 | n/a | n/a | GGCCTGGATACAGCCTTTCT | 5-10-5 | 70 | 23825 | 23844 | 1128 |
| 546977 | n/a | n/a | GTCCCGAAGAGTCAAGTCCA | 5-10-5 | 76 | 24253 | 24272 | 1129 |
| 546979 | n/a | n/a | ACTGTTGTCCATAGCAGCAT | 5-10-5 | 71 | 24504 | 24523 | 1130 |
| 546980 | n/a | n/a | AGCCCTCAATTGTTGCTGGT | 5-10-5 | 79 | 24664 | 24683 | 1131 |
| 546983 | n/a | n/a | GATGACCTGCAGATGCACAG | 5-10-5 | 74 | 24978 | 24997 | 1132 |
| 546986 | n/a | n/a | CAGGATAGAACTGATGGTCC | 5-10-5 | 91 | 25318 | 25337 | 1133 |
| 546990 | n/a | n/a | AGAACAGGAGACAATCCACT | 5-10-5 | 49 | 25680 | 25699 | 1134 |
| 546994 | n/a | n/a | GTTCATGTGGCAACCTGTGA | 5-10-5 | 58 | 26112 | 26131 | 1135 |
| 547677 | n/a | n/a | CATCACTGTCCTATAACTAT | 5-10-5 | 62 | 16105 | 16124 | 1136 |
| 547678 | n/a | n/a | TACCTATATCACTGTAACTA | 5-10-5 | 21 | 16125 | 16144 | 1137 |
| 547679 | n/a | n/a | TGTACCTATATCACTGTAAC | 5-10-5 | 28 | 16127 | 16146 | 1138 |
| 547680 | n/a | n/a | TATCACTGTACCTATATCAC | 5-10-5 | 41 | 16133 | 16152 | 1139 |
| 547681 | n/a | n/a | AATATCACTGTACCTATATC | 5-10-5 | 6 | 16135 | 16154 | 1140 |
| 547682 | n/a | n/a | CAATATCACTGTACCTATAT | 5-10-5 | 20 | 16136 | 16155 | 1141 |
| 547683 | n/a | n/a | ACTATATCACTGTCCTATAA | 5-10-5 | 33 | 16162 | 16181 | 1142 |
| 547684 | n/a | n/a | TAACTATATCACTGTCCTAT | 5-10-5 | 43 | 16164 | 16183 | 1143 |
| 547685 | n/a | n/a | ATAACTATATCACTGTCCTA | 5-10-5 | 35 | 16165 | 16184 | 1144 |
| 547686 | n/a | n/a | CTGTCCTATAACTATATCAC | 5-10-5 | 36 | 16172 | 16191 | 1145 |
| 547687 | n/a | n/a | ACTGTCCTATAACTATATCA | 5-10-5 | 41 | 16173 | 16192 | 1146 |
| 547688 | n/a | n/a | CACTGTCCTATAACTATATC | 5-10-5 | 47 | 16174 | 16193 | 1147 |
| 547689 | n/a | n/a | GTAACAATATCACTGTCCTA | 5-10-5 | 73 | 16184 | 16203 | 1148 |
| 547690 | n/a | n/a | CTGTAACAATATCACTGTCC | 5-10-5 | 76 | 16186 | 16205 | 1149 |
| 547691 | n/a | n/a | ACTGTAACAATATCACTGTC | 5-10-5 | 36 | 16187 | 16206 | 1150 |
| 547692 | n/a | n/a | CACTGTACCTATAACTGTAA | 5-10-5 | 47 | 16200 | 16219 | 1151 |
| 547693 | n/a | n/a | TCACTGTACCTATAACTGTA | 5-10-5 | 61 | 16201 | 16220 | 1152 |
| 547694 | n/a | n/a | GTCACTGTACCTATAACTGT | 5-10-5 | 92 | 16202 | 16221 | 1153 |
| 547695 | n/a | n/a | ACTGTCCTATAACTATTACA | 5-10-5 | 31 | 16224 | 16243 | 1154 |
| 547696 | n/a | n/a | CACTGTCCTATAACTATTAC | 5-10-5 | 26 | 16225 | 16244 | 1155 |
| 547697 | n/a | n/a | TCACTGTCCTATAACTATTA | 5-10-5 | 63 | 16226 | 16245 | 1156 |
| 547698 | n/a | n/a | ACCTATAACTATAACAATAT | 5-10-5 | 0 | 16245 | 16264 | 1157 |
| 547699 | n/a | n/a | TACCTATAACTATAACAATA | 5-10-5 | 10 | 16246 | 16265 | 1158 |

TABLE 137-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547700 | n/a | n/a | GTACCTATAACTATAACAAT | 5-10-5 | 0 | 16247 | 16266 | 1159 |
| 547701 | n/a | n/a | CATCACTGTACCTATAACTA | 5-10-5 | 49 | 16254 | 16273 | 1160 |
| 547702 | n/a | n/a | ACATCACTGTACCTATAACT | 5-10-5 | 44 | 16255 | 16274 | 1161 |
| 547703 | n/a | n/a | CAACATCACTGTACCTATAA | 5-10-5 | 25 | 16257 | 16276 | 1162 |
| 547704 | n/a | n/a | ACATCTTGTCATTAACATCC | 5-10-5 | 61 | 16435 | 16454 | 1163 |
| 547705 | n/a | n/a | GCACCCAATACAGGGCCAGG | 5-10-5 | 69 | 16512 | 16531 | 1164 |
| 547706 | n/a | n/a | TGCCTCCTGGCAGCCTTCAA | 5-10-5 | 73 | 16694 | 16713 | 1165 |
| 547707 | n/a | n/a | TGAAAAGCCACGCCCTTAGC | 5-10-5 | 32 | 16975 | 16994 | 1166 |
| 547708 | n/a | n/a | GCCAGGAGACAGCCCTACTC | 5-10-5 | 67 | 17055 | 17074 | 1167 |
| 547709 | n/a | n/a | AGCCCAATGTCCTAACCTGT | 5-10-5 | 76 | 17791 | 17810 | 1168 |
| 547710 | n/a | n/a | TGCGGTTATATGGGCTGAAG | 5-10-5 | 85 | 19540 | 19559 | 1169 |
| 547711 | n/a | n/a | CCTTTAGCCACTCCTCTTGC | 5-10-5 | 45 | 20061 | 20080 | 1170 |
| 547712 | n/a | n/a | CCCCATGGTACCAAAGCCAT | 5-10-5 | 79 | 20528 | 20547 | 1171 |
| 547713 | n/a | n/a | CTCAATGCCACCCTTTCCCC | 5-10-5 | 37 | 20880 | 20899 | 1172 |
| 547714 | n/a | n/a | CTGTCTAACTGGCCTGGCTG | 5-10-5 | 19 | 21326 | 21345 | 1173 |
| 547715 | n/a | n/a | GGTCAGAAGGCCTCTTATTC | 5-10-5 | 21 | 21750 | 21769 | 1174 |
| 547716 | n/a | n/a | CCATCTGTCCCCTCAATCCC | 5-10-5 | 9 | 22197 | 22216 | 1175 |
| 547717 | n/a | n/a | ACTCTGGCACTGGTCATGGA | 5-10-5 | 54 | 22761 | 22780 | 1176 |
| 547718 | n/a | n/a | ATAAAGTGCGATTAAGCCCC | 5-10-5 | 86 | 23515 | 23534 | 1177 |
| 547719 | n/a | n/a | TACCAAGCTTGTAGAAGGGA | 5-10-5 | 69 | 23633 | 23652 | 1178 |
| 547720 | n/a | n/a | GAAAGACGGCCAATGGGAAA | 5-10-5 | 8 | 24177 | 24196 | 1179 |
| 547721 | n/a | n/a | CTCTATCAAAATCCTGCTGC | 5-10-5 | 68 | 25527 | 25546 | 1180 |
| 547722 | n/a | n/a | CTCCAGTCACCACCATTGCC | 5-10-5 | 80 | 25860 | 25879 | 1181 |

TABLE 138

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 91 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |

TABLE 138-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15887 | 15906 | |
| | | | | | | 15945 | 15964 | |
| 546599 | n/a | n/a | AAGAGTAAGCCTTCACAGGG | 5-10-5 | 82 | 27583 | 27602 | 1182 |
| 546606 | n/a | n/a | CTCACCAGAGTTGTCCCCAG | 5-10-5 | 0 | 27722 | 27741 | 1183 |
| 546999 | n/a | n/a | GCAGCTCACACCCAAAAAGC | 5-10-5 | 29 | 27004 | 27023 | 1184 |
| 547000 | n/a | n/a | TCTGTTACCTTGAGGATTGT | 5-10-5 | 63 | 27276 | 27295 | 1185 |
| 547006 | n/a | n/a | CGCCATCTGCCCTGTACAGA | 5-10-5 | 39 | 28248 | 28267 | 1186 |
| 547008 | n/a | n/a | TTGGTGGTGGGATTGGTGGT | 5-10-5 | 81 | 28333 | 28352 | 1187 |
| | | | | | | 28388 | 28407 | |
| | | | | | | 28443 | 28462 | |
| | | | | | | 28608 | 28627 | |
| | | | | | | 28620 | 28639 | |
| 547009 | n/a | n/a | AATTGGTGGTGGGATTGGTG | 5-10-5 | 73 | 28335 | 28354 | 1188 |
| 547010 | n/a | n/a | GAATTGGTGGTGGGATTGGT | 5-10-5 | 39 | 28336 | 28355 | 1189 |
| 547011 | n/a | n/a | GGCAGGATTGGTGGTGGAAT | 5-10-5 | 22 | 28352 | 28371 | 1190 |
| 547013 | n/a | n/a | TGAGATTGGTGGTGGGTGGC | 5-10-5 | 0 | 28369 | 28388 | 1191 |
| 547015 | n/a | n/a | GGTGGTGGGATTGGTGCTGA | 5-10-5 | 55 | 28429 | 28448 | 1192 |
| 547016 | n/a | n/a | GTAGGTGGTGGGATTGGTGG | 5-10-5 | 62 | 28456 | 28475 | 1193 |
| | | | | | | 28535 | 28554 | |
| 547017 | n/a | n/a | GGTAGGTGGTGGGATTGGTG | 5-10-5 | 61 | 28457 | 28476 | 1194 |
| | | | | | | 28536 | 28555 | |
| 547018 | n/a | n/a | GGTGGCGGGATTGGTGGTGG | 5-10-5 | 58 | 28477 | 28496 | 1195 |
| | | | | | | 28556 | 28575 | |
| 547019 | n/a | n/a | GATCGGTGGTGGGATTGGTC | 5-10-5 | 83 | 28500 | 28519 | 1196 |
| | | | | | | 28579 | 28598 | |
| 547020 | n/a | n/a | GGATCGGTGGTGGGATTGGT | 5-10-5 | 47 | 28501 | 28520 | 1197 |
| | | | | | | 28580 | 28599 | |
| 547021 | n/a | n/a | TTGGTGGCGGGATCGGTGGT | 5-10-5 | 57 | 28510 | 28529 | 1198 |
| | | | | | | 28589 | 28608 | |
| 547022 | n/a | n/a | ATTGGTGGCGGGATCGGTGG | 5-10-5 | 69 | 28511 | 28530 | 1199 |
| 547023 | n/a | n/a | GATTGGTGGCGGGATCGGTG | 5-10-5 | 91 | 28512 | 28531 | 1200 |
| 547024 | n/a | n/a | GGATTGGTGGCGGGATCGGT | 5-10-5 | 56 | 28513 | 28532 | 1201 |
| 547025 | n/a | n/a | TGGTGGTGGGATTGGTGGTT | 5-10-5 | 72 | 28607 | 28626 | 1202 |
| 547029 | n/a | n/a | TCTTCTAGGGCCACACCTCT | 5-10-5 | 50 | 28891 | 28910 | 1203 |
| 547035 | n/a | n/a | TGGTCCCAAATTGGAGTGCA | 5-10-5 | 40 | 29383 | 29402 | 1204 |
| 547039 | n/a | n/a | TCTCTATACAGCTGGGCACA | 5-10-5 | 0 | 29997 | 30016 | 1205 |
| 547049 | n/a | n/a | CACTTCCCAGCAACCCTCAC | 5-10-5 | 20 | 30765 | 30784 | 1206 |
| 547055 | n/a | n/a | GCTCCTGGCAGCAATGACCC | 5-10-5 | 70 | 31104 | 31123 | 1207 |
| 547059 | n/a | n/a | GGGTATCTTCACTGTTCCAG | 5-10-5 | 12 | 31540 | 31559 | 1208 |
| 547063 | n/a | n/a | CGTCATGCTTACCTTTCTCC | 5-10-5 | 23 | 31955 | 31974 | 1209 |
| 547069 | n/a | n/a | GCCCTCCGAGCTTTGGCAAC | 5-10-5 | 35 | 32581 | 32600 | 1210 |
| 547071 | n/a | n/a | GCAGCCCCCAGAAATCCCA | 5-10-5 | 27 | 32708 | 32727 | 1211 |

TABLE 138-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547076 | n/a | n/a | TCTCAAGCAGCCTATTGTGT | 5-10-5 | 14 | 33263 | 33282 | 1212 |
| 547080 | n/a | n/a | GTGCAAGACCTTGCTTGCCA | 5-10-5 | 54 | 33657 | 33676 | 1213 |
| 547081 | n/a | n/a | CTGTAGTCCACTACACAGCA | 5-10-5 | 83 | 33801 | 33820 | 1214 |
| 547082 | n/a | n/a | TCTCCCTGAGTCACAGTGGA | 5-10-5 | 64 | 33881 | 33900 | 1215 |
| 547085 | n/a | n/a | CCAGGTGCAGCACGGAGAGG | 5-10-5 | 44 | 34479 | 34498 | 1216 |
| 547723 | n/a | n/a | TAGAATGGCAGGGTTCTGTG | 5-10-5 | 53 | 27357 | 27376 | 1217 |
| 547724 | n/a | n/a | GATGCATCCAACACTTACCC | 5-10-5 | 16 | 28059 | 28078 | 1218 |
| 547725 | n/a | n/a | ATTGGTGGTGGGATTGGTGG | 5-10-5 | 26 | 28334 28389 28444 28523 28609 28621 | 28353 28408 28463 28542 28628 28640 | 1219 |
| 547726 | n/a | n/a | GCAGGATTGGTGGTGGAATT | 5-10-5 | 0 | 28351 | 28370 | 1220 |
| 547727 | n/a | n/a | TGGCAGGATTGGTGGTGGAA | 5-10-5 | 0 | 28353 | 28372 | 1221 |
| 547728 | n/a | n/a | GAGATTGGTGGTGGGTGGCA | 5-10-5 | 88 | 28368 | 28387 | 1222 |
| 547729 | n/a | n/a | GTGAGATTGGTGGTGGGTGG | 5-10-5 | 45 | 28370 | 28389 | 1223 |
| 547730 | n/a | n/a | GATTGGTGGTGGGATTGGTG | 5-10-5 | 60 | 28390 28433 28445 28524 28610 28622 | 28409 28452 28464 28543 28629 28641 | 1224 |
| 547731 | n/a | n/a | GGATTGGTGGTGGGATTGGT | 5-10-5 | 49 | 28391 28434 28446 28525 28611 28623 | 28410 28453 28465 28544 28630 28642 | 1225 |
| 547732 | n/a | n/a | AGGATTGGTGGTGGGATTGG | 5-10-5 | 0 | 28392 | 28411 | 1226 |
| 547733 | n/a | n/a | TAGGATTGGTGGTGGGATTG | 5-10-5 | 0 | 28393 | 28412 | 1227 |
| 547734 | n/a | n/a | GTAGGATTGGTGGTGGGATT | 5-10-5 | 14 | 28394 | 28413 | 1228 |
| 547735 | n/a | n/a | GGTAGGATTGGTGGTGGGAT | 5-10-5 | 39 | 28395 | 28414 | 1229 |
| 547736 | n/a | n/a | TGGTAGGATTGGTGGTGGGA | 5-10-5 | 54 | 28396 | 28415 | 1230 |
| 547737 | n/a | n/a | TGGTGGTGGGATTGGTGCTG | 5-10-5 | 59 | 28430 | 28449 | 1231 |
| 547738 | n/a | n/a | TTGGTGGTGGGATTGGTGCT | 5-10-5 | 41 | 28431 | 28450 | 1232 |
| 547739 | n/a | n/a | ATTGGTGGTGGGATTGGTGC | 5-10-5 | 12 | 28432 | 28451 | 1233 |
| 547740 | n/a | n/a | AGGTGGTGGGATTGGTGGTG | 5-10-5 | 30 | 28454 28533 | 28473 28552 | 1234 |
| 547741 | n/a | n/a | TAGGTGGTGGGATTGGTGGT | 5-10-5 | 47 | 28455 28534 | 28474 28553 | 1235 |
| 547742 | n/a | n/a | ATCGGTGGTGGGATTGGTCG | 5-10-5 | 57 | 28499 28578 | 28518 28597 | 1236 |
| 547743 | n/a | n/a | GGTGGTGGGATTGGTGGCGG | 5-10-5 | 61 | 28520 | 28539 | 1237 |
| 547744 | n/a | n/a | TGGTGGTGGGATTGGTGGCG | 5-10-5 | 65 | 28521 | 28540 | 1238 |
| 547745 | n/a | n/a | TTGGTGGTGGGATTGGTGGC | 5-10-5 | 55 | 28522 | 28541 | 1239 |

TABLE 138-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 547746 | n/a | n/a | GTTGGTGGCGGGATCGGTGG | 5-10-5 | 0 | 28590 | 28609 | 1240 |
| 547748 | n/a | n/a | GGTTGGTGGCGGGATCGGTG | 5-10-5 | 78 | 28591 | 28610 | 1241 |
| 547750 | n/a | n/a | TGGTTGGTGGCGGGATCGGT | 5-10-5 | 41 | 28592 | 28611 | 1242 |
| 547752 | n/a | n/a | GTGGTTGGTGGCGGGATCGG | 5-10-5 | 41 | 28593 | 28612 | 1243 |
| 547754 | n/a | n/a | GGGATTGGTGGTTGGTGGCG | 5-10-5 | 47 | 28600 | 28619 | 1244 |
| 547756 | n/a | n/a | GGGTCTTGCTCCACCCACAT | 5-10-5 | 49 | 29244 | 29263 | 1245 |
| 547758 | n/a | n/a | CCAAGTAGTGCAAGGCATGT | 5-10-5 | 24 | 29540 | 29559 | 1246 |
| 547760 | n/a | n/a | ATCATGCTTACTGCAAGTGA | 5-10-5 | 19 | 30219 | 30238 | 1247 |
| 547762 | n/a | n/a | TGAAACTGGGCAGTCCTTCC | 5-10-5 | 0 | 30417 | 30436 | 1248 |
| 547764 | n/a | n/a | CCACCTTCTTACATATGCTA | 5-10-5 | 24 | 30644 | 30663 | 1249 |
| 547766 | n/a | n/a | GCCTCTCAGACGGCACAGAC | 5-10-5 | 0 | 30902 | 30921 | 1250 |
| 547768 | n/a | n/a | TTGCCCTCACACATTCGAAT | 5-10-5 | 0 | 30977 | 30996 | 1251 |
| 547770 | n/a | n/a | TGCTTTCTGCCCAACCTCTA | 5-10-5 | 48 | 31727 | 31746 | 1252 |
| 547772 | n/a | n/a | CTGTGCTCCCGGCCATTAGC | 5-10-5 | 0 | 32312 | 32331 | 1253 |
| 547774 | n/a | n/a | GAGACAGTTTGGCAAGCTAC | 5-10-5 | 46 | 32389 | 32408 | 1254 |
| 547776 | n/a | n/a | GGAGAGAGACGGCACCCTGT | 5-10-5 | 48 | 32828 | 32847 | 1255 |
| 547778 | n/a | n/a | TCACCTGTGAGTAACCAATA | 5-10-5 | 53 | 33085 | 33104 | 1256 |
| 547780 | n/a | n/a | CCCCTCTTAAATAGCACATG | 5-10-5 | 67 | 33441 | 33460 | 1257 |
| 547782 | n/a | n/a | CCAAGTATCTCATGTGCCTG | 5-10-5 | 67 | 33580 | 33599 | 1258 |

TABLE 139

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | 5-10-5 | 90 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548706 | n/a | n/a | CTAGTTTCCTATAACT | 3-10-3 | 0 | 14738 | 14753 | 1259 |
|  |  |  |  |  |  | 14809 | 14824 |  |
|  |  |  |  |  |  | 14880 | 14895 |  |
|  |  |  |  |  |  | 14939 | 14954 |  |
|  |  |  |  |  |  | 15071 | 15086 |  |
|  |  |  |  |  |  | 15214 | 15229 |  |
|  |  |  |  |  |  | 15286 | 15301 |  |
|  |  |  |  |  |  | 15345 | 15360 |  |
|  |  |  |  |  |  | 15477 | 15492 |  |
|  |  |  |  |  |  | 15549 | 15564 |  |
|  |  |  |  |  |  | 15607 | 15622 |  |
|  |  |  |  |  |  | 15679 | 15694 |  |
|  |  |  |  |  |  | 15750 | 15765 |  |
|  |  |  |  |  |  | 15809 | 15824 |  |
|  |  |  |  |  |  | 15881 | 15896 |  |
|  |  |  |  |  |  | 15939 | 15954 |  |
| 548707 | n/a | n/a | ACTAGTTTCCTATAAC | 3-10-3 | 10 | 14739 | 14754 | 1260 |
|  |  |  |  |  |  | 14810 | 14825 |  |
|  |  |  |  |  |  | 14881 | 14896 |  |
|  |  |  |  |  |  | 14940 | 14955 |  |
|  |  |  |  |  |  | 15000 | 15015 |  |
|  |  |  |  |  |  | 15072 | 15087 |  |
|  |  |  |  |  |  | 15215 | 15230 |  |
|  |  |  |  |  |  | 15287 | 15302 |  |
|  |  |  |  |  |  | 15346 | 15361 |  |
|  |  |  |  |  |  | 15406 | 15421 |  |
|  |  |  |  |  |  | 15478 | 15493 |  |
|  |  |  |  |  |  | 15550 | 15565 |  |
|  |  |  |  |  |  | 15608 | 15623 |  |
|  |  |  |  |  |  | 15680 | 15695 |  |
|  |  |  |  |  |  | 15751 | 15766 |  |
|  |  |  |  |  |  | 15810 | 15825 |  |
|  |  |  |  |  |  | 15882 | 15897 |  |
|  |  |  |  |  |  | 15940 | 15955 |  |
| 548708 | n/a | n/a | TACTAGTTTCCTATAA | 3-10-3 | 0 | 14740 | 14755 | 1261 |
|  |  |  |  |  |  | 14811 | 14826 |  |
|  |  |  |  |  |  | 14882 | 14897 |  |
|  |  |  |  |  |  | 14941 | 14956 |  |
|  |  |  |  |  |  | 15001 | 15016 |  |
|  |  |  |  |  |  | 15073 | 15088 |  |
|  |  |  |  |  |  | 15216 | 15231 |  |
|  |  |  |  |  |  | 15288 | 15303 |  |
|  |  |  |  |  |  | 15347 | 15362 |  |
|  |  |  |  |  |  | 15407 | 15422 |  |
|  |  |  |  |  |  | 15479 | 15494 |  |
|  |  |  |  |  |  | 15551 | 15566 |  |
|  |  |  |  |  |  | 15609 | 15624 |  |
|  |  |  |  |  |  | 15681 | 15696 |  |
|  |  |  |  |  |  | 15752 | 15767 |  |
|  |  |  |  |  |  | 15811 | 15826 |  |
|  |  |  |  |  |  | 15883 | 15898 |  |
|  |  |  |  |  |  | 15941 | 15956 |  |
| 548709 | n/a | n/a | GTACTAGTTTCCTATA | 3-10-3 | 0 | 14741 | 14756 | 1262 |
|  |  |  |  |  |  | 14812 | 14827 |  |
|  |  |  |  |  |  | 14883 | 14898 |  |
|  |  |  |  |  |  | 14942 | 14957 |  |
|  |  |  |  |  |  | 15002 | 15017 |  |
|  |  |  |  |  |  | 15074 | 15089 |  |
|  |  |  |  |  |  | 15217 | 15232 |  |
|  |  |  |  |  |  | 15289 | 15304 |  |
|  |  |  |  |  |  | 15348 | 15363 |  |
|  |  |  |  |  |  | 15408 | 15423 |  |
|  |  |  |  |  |  | 15480 | 15495 |  |
|  |  |  |  |  |  | 15552 | 15567 |  |
|  |  |  |  |  |  | 15610 | 15625 |  |
|  |  |  |  |  |  | 15682 | 15697 |  |
|  |  |  |  |  |  | 15753 | 15768 |  |
|  |  |  |  |  |  | 15812 | 15827 |  |
|  |  |  |  |  |  | 15884 | 15899 |  |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15942 | 15957 | |
| 548710 | n/a | n/a | TGTACTAGTTTCCTAT | 3-10-3 | 0 | 14742 | 14757 | 1263 |
| | | | | | | 14813 | 14828 | |
| | | | | | | 14884 | 14899 | |
| | | | | | | 14943 | 14958 | |
| | | | | | | 15003 | 15018 | |
| | | | | | | 15075 | 15090 | |
| | | | | | | 15218 | 15233 | |
| | | | | | | 15290 | 15305 | |
| | | | | | | 15349 | 15364 | |
| | | | | | | 15409 | 15424 | |
| | | | | | | 15481 | 15496 | |
| | | | | | | 15553 | 15568 | |
| | | | | | | 15611 | 15626 | |
| | | | | | | 15683 | 15698 | |
| | | | | | | 15813 | 15828 | |
| | | | | | | 15885 | 15900 | |
| | | | | | | 15943 | 15958 | |
| 548711 | n/a | n/a | CTGTACTAGTTTCCTA | 3-10-3 | 21 | 14743 | 14758 | 1264 |
| | | | | | | 14814 | 14829 | |
| | | | | | | 14885 | 14900 | |
| | | | | | | 14944 | 14959 | |
| | | | | | | 15004 | 15019 | |
| | | | | | | 15076 | 15091 | |
| | | | | | | 15219 | 15234 | |
| | | | | | | 15291 | 15306 | |
| | | | | | | 15350 | 15365 | |
| | | | | | | 15410 | 15425 | |
| | | | | | | 15482 | 15497 | |
| | | | | | | 15554 | 15569 | |
| | | | | | | 15612 | 15627 | |
| | | | | | | 15684 | 15699 | |
| | | | | | | 15814 | 15829 | |
| | | | | | | 15886 | 15901 | |
| | | | | | | 15944 | 15959 | |
| 548712 | n/a | n/a | ACTGTACTAGTTTCCT | 3-10-3 | 9 | 14744 | 14759 | 1265 |
| | | | | | | 14815 | 14830 | |
| | | | | | | 14886 | 14901 | |
| | | | | | | 14945 | 14960 | |
| | | | | | | 15005 | 15020 | |
| | | | | | | 15077 | 15092 | |
| | | | | | | 15220 | 15235 | |
| | | | | | | 15292 | 15307 | |
| | | | | | | 15351 | 15366 | |
| | | | | | | 15411 | 15426 | |
| | | | | | | 15483 | 15498 | |
| | | | | | | 15555 | 15570 | |
| | | | | | | 15613 | 15628 | |
| | | | | | | 15685 | 15700 | |
| | | | | | | 15815 | 15830 | |
| | | | | | | 15887 | 15902 | |
| | | | | | | 15945 | 15960 | |
| 548713 | n/a | n/a | CACTGTACTAGTTTCC | 3-10-3 | 33 | 14745 | 14760 | 1266 |
| | | | | | | 14816 | 14831 | |
| | | | | | | 14887 | 14902 | |
| | | | | | | 14946 | 14961 | |
| | | | | | | 15006 | 15021 | |
| | | | | | | 15078 | 15093 | |
| | | | | | | 15221 | 15236 | |
| | | | | | | 15293 | 15308 | |
| | | | | | | 15352 | 15367 | |
| | | | | | | 15412 | 15427 | |
| | | | | | | 15484 | 15499 | |
| | | | | | | 15556 | 15571 | |
| | | | | | | 15614 | 15629 | |
| | | | | | | 15686 | 15701 | |
| | | | | | | 15816 | 15831 | |
| | | | | | | 15888 | 15903 | |
| | | | | | | 15946 | 15961 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548714 | n/a | n/a | TCACTGTACTAGTTTC | 3-10-3 | 15 | 14746 | 14761 | 1267 |
| | | | | | | 14817 | 14832 | |
| | | | | | | 14888 | 14903 | |
| | | | | | | 14947 | 14962 | |
| | | | | | | 15007 | 15022 | |
| | | | | | | 15079 | 15094 | |
| | | | | | | 15222 | 15237 | |
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 548715 | n/a | n/a | ATCACTGTACTAGTTT | 3-10-3 | 0 | 14747 | 14762 | 1268 |
| | | | | | | 14818 | 14833 | |
| | | | | | | 14889 | 14904 | |
| | | | | | | 14948 | 14963 | |
| | | | | | | 15008 | 15023 | |
| | | | | | | 15080 | 15095 | |
| | | | | | | 15152 | 15167 | |
| | | | | | | 15223 | 15238 | |
| | | | | | | 15295 | 15310 | |
| | | | | | | 15354 | 15369 | |
| | | | | | | 15414 | 15429 | |
| | | | | | | 15486 | 15501 | |
| | | | | | | 15558 | 15573 | |
| | | | | | | 15616 | 15631 | |
| | | | | | | 15688 | 15703 | |
| | | | | | | 15818 | 15833 | |
| | | | | | | 15890 | 15905 | |
| | | | | | | 15948 | 15963 | |
| | | | | | | 14748 | 14763 | |
| 548716 | n/a | n/a | TATCACTGTACTAGTT | 3-10-3 | 10 | 14819 | 14834 | 1269 |
| | | | | | | 14890 | 14905 | |
| | | | | | | 14949 | 14964 | |
| | | | | | | 15009 | 15024 | |
| | | | | | | 15081 | 15096 | |
| | | | | | | 15153 | 15168 | |
| | | | | | | 15224 | 15239 | |
| | | | | | | 15296 | 15311 | |
| | | | | | | 15355 | 15370 | |
| | | | | | | 15415 | 15430 | |
| | | | | | | 15487 | 15502 | |
| | | | | | | 15559 | 15574 | |
| | | | | | | 15617 | 15632 | |
| | | | | | | 15689 | 15704 | |
| | | | | | | 15819 | 15834 | |
| | | | | | | 15891 | 15906 | |
| | | | | | | 15949 | 15964 | |
| 548717 | n/a | n/a | ACTAGTTTCCTATAACT | 3-10-4 | 0 | 14738 | 14754 | 1270 |
| | | | | | | 14809 | 14825 | |
| | | | | | | 14880 | 14896 | |
| | | | | | | 14939 | 14955 | |
| | | | | | | 15071 | 15087 | |
| | | | | | | 15214 | 15230 | |
| | | | | | | 15286 | 15302 | |
| | | | | | | 15345 | 15361 | |
| | | | | | | 15477 | 15493 | |
| | | | | | | 15549 | 15565 | |
| | | | | | | 15607 | 15623 | |
| | | | | | | 15679 | 15695 | |
| | | | | | | 15750 | 15766 | |
| | | | | | | 15809 | 15825 | |
| | | | | | | 15881 | 15897 | |
| | | | | | | 15939 | 15955 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548718 | n/a | n/a | TACTAGTTTCCTATAAC | 3-10-4 | 0 | 14739 | 14755 | 1271 |
| | | | | | | 14810 | 14826 | |
| | | | | | | 14881 | 14897 | |
| | | | | | | 14940 | 14956 | |
| | | | | | | 15000 | 15016 | |
| | | | | | | 15072 | 15088 | |
| | | | | | | 15215 | 15231 | |
| | | | | | | 15287 | 15303 | |
| | | | | | | 15346 | 15362 | |
| | | | | | | 15406 | 15422 | |
| | | | | | | 15478 | 15494 | |
| | | | | | | 15550 | 15566 | |
| | | | | | | 15608 | 15624 | |
| | | | | | | 15680 | 15696 | |
| | | | | | | 15751 | 15767 | |
| | | | | | | 15810 | 15826 | |
| | | | | | | 15882 | 15898 | |
| | | | | | | 15940 | 15956 | |
| 548719 | n/a | n/a | GTACTAGTTTCCTATAA | 3-10-4 | 0 | 14740 | 14756 | 1272 |
| | | | | | | 14811 | 14827 | |
| | | | | | | 14882 | 14898 | |
| | | | | | | 14941 | 14957 | |
| | | | | | | 15001 | 15017 | |
| | | | | | | 15073 | 15089 | |
| | | | | | | 15216 | 15232 | |
| | | | | | | 15288 | 15304 | |
| | | | | | | 15347 | 15363 | |
| | | | | | | 15407 | 15423 | |
| | | | | | | 15479 | 15495 | |
| | | | | | | 15551 | 15567 | |
| | | | | | | 15609 | 15625 | |
| | | | | | | 15681 | 15697 | |
| | | | | | | 15752 | 15768 | |
| | | | | | | 15811 | 15827 | |
| | | | | | | 15883 | 15899 | |
| | | | | | | 15941 | 15957 | |
| 548720 | n/a | n/a | TGTACTAGTTTCCTATA | 3-10-4 | 0 | 14741 | 14757 | 1273 |
| | | | | | | 14812 | 14828 | |
| | | | | | | 14883 | 14899 | |
| | | | | | | 14942 | 14958 | |
| | | | | | | 15002 | 15018 | |
| | | | | | | 15074 | 15090 | |
| | | | | | | 15217 | 15233 | |
| | | | | | | 15289 | 15305 | |
| | | | | | | 15348 | 15364 | |
| | | | | | | 15408 | 15424 | |
| | | | | | | 15480 | 15496 | |
| | | | | | | 15552 | 15568 | |
| | | | | | | 15610 | 15626 | |
| | | | | | | 15682 | 15698 | |
| | | | | | | 15812 | 15828 | |
| | | | | | | 15884 | 15900 | |
| | | | | | | 15942 | 15958 | |
| 548721 | n/a | n/a | CTGTACTAGTTTCCTAT | 3-10-4 | 27 | 14742 | 14758 | 1274 |
| | | | | | | 14813 | 14829 | |
| | | | | | | 14884 | 14900 | |
| | | | | | | 14943 | 14959 | |
| | | | | | | 15003 | 15019 | |
| | | | | | | 15075 | 15091 | |
| | | | | | | 15218 | 15234 | |
| | | | | | | 15290 | 15306 | |
| | | | | | | 15349 | 15365 | |
| | | | | | | 15409 | 15425 | |
| | | | | | | 15481 | 15497 | |
| | | | | | | 15553 | 15569 | |
| | | | | | | 15611 | 15627 | |
| | | | | | | 15683 | 15699 | |
| | | | | | | 15813 | 15829 | |
| | | | | | | 15885 | 15901 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15943 | 15959 | |
| 548722 | n/a | n/a | ACTGTACTAGTTTCCTA | 3-10-4 | 26 | 14743 | 14759 | 1275 |
| | | | | | | 14814 | 14830 | |
| | | | | | | 14885 | 14901 | |
| | | | | | | 14944 | 14960 | |
| | | | | | | 15004 | 15020 | |
| | | | | | | 15076 | 15092 | |
| | | | | | | 15219 | 15235 | |
| | | | | | | 15291 | 15307 | |
| | | | | | | 15350 | 15366 | |
| | | | | | | 15410 | 15426 | |
| | | | | | | 15482 | 15498 | |
| | | | | | | 15554 | 15570 | |
| | | | | | | 15612 | 15628 | |
| | | | | | | 15684 | 15700 | |
| | | | | | | 15814 | 15830 | |
| | | | | | | 15886 | 15902 | |
| | | | | | | 15944 | 15960 | |
| 548723 | n/a | n/a | CACTGTACTAGTTTCCT | 3-10-4 | 62 | 14744 | 14760 | 1276 |
| | | | | | | 14815 | 14831 | |
| | | | | | | 14886 | 14902 | |
| | | | | | | 14945 | 14961 | |
| | | | | | | 15005 | 15021 | |
| | | | | | | 15077 | 15093 | |
| | | | | | | 15220 | 15236 | |
| | | | | | | 15292 | 15308 | |
| | | | | | | 15351 | 15367 | |
| | | | | | | 15411 | 15427 | |
| | | | | | | 15483 | 15499 | |
| | | | | | | 15555 | 15571 | |
| | | | | | | 15613 | 15629 | |
| | | | | | | 15685 | 15701 | |
| | | | | | | 15815 | 15831 | |
| | | | | | | 15887 | 15903 | |
| | | | | | | 15945 | 15961 | |
| 548724 | n/a | n/a | TCACTGTACTAGTTTCC | 3-10-4 | 61 | 14745 | 14761 | 1277 |
| | | | | | | 14816 | 14832 | |
| | | | | | | 14887 | 14903 | |
| | | | | | | 14946 | 14962 | |
| | | | | | | 15006 | 15022 | |
| | | | | | | 15078 | 15094 | |
| | | | | | | 15221 | 15237 | |
| | | | | | | 15293 | 15309 | |
| | | | | | | 15352 | 15368 | |
| | | | | | | 15412 | 15428 | |
| | | | | | | 15484 | 15500 | |
| | | | | | | 15556 | 15572 | |
| | | | | | | 15614 | 15630 | |
| | | | | | | 15686 | 15702 | |
| | | | | | | 15816 | 15832 | |
| | | | | | | 15888 | 15904 | |
| | | | | | | 15946 | 15962 | |
| 548725 | n/a | n/a | ATCACTGTACTAGTTTC | 3-10-4 | 32 | 14746 | 14762 | 1278 |
| | | | | | | 14817 | 14833 | |
| | | | | | | 14888 | 14904 | |
| | | | | | | 14947 | 14963 | |
| | | | | | | 15007 | 15023 | |
| | | | | | | 15079 | 15095 | |
| | | | | | | 15222 | 15238 | |
| | | | | | | 15294 | 15310 | |
| | | | | | | 15353 | 15369 | |
| | | | | | | 15413 | 15429 | |
| | | | | | | 15485 | 15501 | |
| | | | | | | 15557 | 15573 | |
| | | | | | | 15615 | 15631 | |
| | | | | | | 15687 | 15703 | |
| | | | | | | 15817 | 15833 | |
| | | | | | | 15889 | 15905 | |
| | | | | | | 15947 | 15963 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 14747 | 14763 | |
| 548726 | n/a | n/a | TATCACTGTACTAGTTT | 3-10-4 | 21 | 14818 | 14834 | 1279 |
| | | | | | | 14889 | 14905 | |
| | | | | | | 14948 | 14964 | |
| | | | | | | 15008 | 15024 | |
| | | | | | | 15080 | 15096 | |
| | | | | | | 15152 | 15168 | |
| | | | | | | 15223 | 15239 | |
| | | | | | | 15295 | 15311 | |
| | | | | | | 15354 | 15370 | |
| | | | | | | 15414 | 15430 | |
| | | | | | | 15486 | 15502 | |
| | | | | | | 15558 | 15574 | |
| | | | | | | 15616 | 15632 | |
| | | | | | | 15688 | 15704 | |
| | | | | | | 15818 | 15834 | |
| | | | | | | 15890 | 15906 | |
| | | | | | | 15948 | 15964 | |
| 548727 | n/a | n/a | ACTAGTTTCCTATAACT | 4-10-3 | 0 | 14738 | 14754 | 1270 |
| | | | | | | 14809 | 14825 | |
| | | | | | | 14880 | 14896 | |
| | | | | | | 14939 | 14955 | |
| | | | | | | 15071 | 15087 | |
| | | | | | | 15214 | 15230 | |
| | | | | | | 15286 | 15302 | |
| | | | | | | 15345 | 15361 | |
| | | | | | | 15477 | 15493 | |
| | | | | | | 15549 | 15565 | |
| | | | | | | 15607 | 15623 | |
| | | | | | | 15679 | 15695 | |
| | | | | | | 15750 | 15766 | |
| | | | | | | 15809 | 15825 | |
| | | | | | | 15881 | 15897 | |
| | | | | | | 15939 | 15955 | |
| 548728 | n/a | n/a | TACTAGTTTCCTATAAC | 4-10-3 | 0 | 14739 | 14755 | 1271 |
| | | | | | | 14810 | 14826 | |
| | | | | | | 14881 | 14897 | |
| | | | | | | 14940 | 14956 | |
| | | | | | | 15000 | 15016 | |
| | | | | | | 15072 | 15088 | |
| | | | | | | 15215 | 15231 | |
| | | | | | | 15287 | 15303 | |
| | | | | | | 15346 | 15362 | |
| | | | | | | 15406 | 15422 | |
| | | | | | | 15478 | 15494 | |
| | | | | | | 15550 | 15566 | |
| | | | | | | 15608 | 15624 | |
| | | | | | | 15680 | 15696 | |
| | | | | | | 15751 | 15767 | |
| | | | | | | 15810 | 15826 | |
| | | | | | | 15882 | 15898 | |
| | | | | | | 15940 | 15956 | |
| 548729 | n/a | n/a | GTACTAGTTTCCTATAA | 4-10-3 | 13 | 14740 | 14756 | 1272 |
| | | | | | | 14811 | 14827 | |
| | | | | | | 14882 | 14898 | |
| | | | | | | 14941 | 14957 | |
| | | | | | | 15001 | 15017 | |
| | | | | | | 15073 | 15089 | |
| | | | | | | 15216 | 15232 | |
| | | | | | | 15288 | 15304 | |
| | | | | | | 15347 | 15363 | |
| | | | | | | 15407 | 15423 | |
| | | | | | | 15479 | 15495 | |
| | | | | | | 15551 | 15567 | |
| | | | | | | 15609 | 15625 | |
| | | | | | | 15681 | 15697 | |
| | | | | | | 15752 | 15768 | |
| | | | | | | 15811 | 15827 | |
| | | | | | | 15883 | 15899 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15941 | 15957 | |
| 548730 | n/a | n/a | TGTACTAGTTTCCTATA | 4-10-3 | 0 | 14741 | 14757 | 1273 |
| | | | | | | 14812 | 14828 | |
| | | | | | | 14883 | 14899 | |
| | | | | | | 14942 | 14958 | |
| | | | | | | 15002 | 15018 | |
| | | | | | | 15074 | 15090 | |
| | | | | | | 15217 | 15233 | |
| | | | | | | 15289 | 15305 | |
| | | | | | | 15348 | 15364 | |
| | | | | | | 15408 | 15424 | |
| | | | | | | 15480 | 15496 | |
| | | | | | | 15552 | 15568 | |
| | | | | | | 15610 | 15626 | |
| | | | | | | 15682 | 15698 | |
| | | | | | | 15812 | 15828 | |
| | | | | | | 15884 | 15900 | |
| | | | | | | 15942 | 15958 | |
| 548731 | n/a | n/a | CTGTACTAGTTTCCTAT | 4-10-3 | 49 | 14742 | 14758 | 1274 |
| | | | | | | 14813 | 14829 | |
| | | | | | | 14884 | 14900 | |
| | | | | | | 14943 | 14959 | |
| | | | | | | 15003 | 15019 | |
| | | | | | | 15075 | 15091 | |
| | | | | | | 15218 | 15234 | |
| | | | | | | 15290 | 15306 | |
| | | | | | | 15349 | 15365 | |
| | | | | | | 15409 | 15425 | |
| | | | | | | 15481 | 15497 | |
| | | | | | | 15553 | 15569 | |
| | | | | | | 15611 | 15627 | |
| | | | | | | 15683 | 15699 | |
| | | | | | | 15813 | 15829 | |
| | | | | | | 15885 | 15901 | |
| | | | | | | 15943 | 15959 | |
| 548732 | n/a | n/a | ACTGTACTAGTTTCCTA | 4-10-3 | 36 | 14743 | 14759 | 1275 |
| | | | | | | 14814 | 14830 | |
| | | | | | | 14885 | 14901 | |
| | | | | | | 14944 | 14960 | |
| | | | | | | 15004 | 15020 | |
| | | | | | | 15076 | 15092 | |
| | | | | | | 15219 | 15235 | |
| | | | | | | 15291 | 15307 | |
| | | | | | | 15350 | 15366 | |
| | | | | | | 15410 | 15426 | |
| | | | | | | 15482 | 15498 | |
| | | | | | | 15554 | 15570 | |
| | | | | | | 15612 | 15628 | |
| | | | | | | 15684 | 15700 | |
| | | | | | | 15814 | 15830 | |
| | | | | | | 15886 | 15902 | |
| | | | | | | 15944 | 15960 | |
| 548733 | n/a | n/a | CACTGTACTAGTTTCCT | 4-10-3 | 84 | 14744 | 14760 | 1276 |
| | | | | | | 14815 | 14831 | |
| | | | | | | 14886 | 14902 | |
| | | | | | | 14945 | 14961 | |
| | | | | | | 15005 | 15021 | |
| | | | | | | 15077 | 15093 | |
| | | | | | | 15220 | 15236 | |
| | | | | | | 15292 | 15308 | |
| | | | | | | 15351 | 15367 | |
| | | | | | | 15411 | 15427 | |
| | | | | | | 15483 | 15499 | |
| | | | | | | 15555 | 15571 | |
| | | | | | | 15613 | 15629 | |
| | | | | | | 15685 | 15701 | |
| | | | | | | 15815 | 15831 | |
| | | | | | | 15887 | 15903 | |
| | | | | | | 15945 | 15961 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548734 | n/a | n/a | TCACTGTACTAGTTTCC | 4-10-3 | 51 | 14745 | 14761 | 1277 |
| | | | | | | 14816 | 14832 | |
| | | | | | | 14887 | 14903 | |
| | | | | | | 14946 | 14962 | |
| | | | | | | 15006 | 15022 | |
| | | | | | | 15078 | 15094 | |
| | | | | | | 15221 | 15237 | |
| | | | | | | 15293 | 15309 | |
| | | | | | | 15352 | 15368 | |
| | | | | | | 15412 | 15428 | |
| | | | | | | 15484 | 15500 | |
| | | | | | | 15556 | 15572 | |
| | | | | | | 15614 | 15630 | |
| | | | | | | 15686 | 15702 | |
| | | | | | | 15816 | 15832 | |
| | | | | | | 15888 | 15904 | |
| | | | | | | 15946 | 15962 | |
| 548735 | n/a | n/a | ATCACTGTACTAGTTTC | 4-10-3 | 48 | 14746 | 14762 | 1278 |
| | | | | | | 14817 | 14833 | |
| | | | | | | 14888 | 14904 | |
| | | | | | | 14947 | 14963 | |
| | | | | | | 15007 | 15023 | |
| | | | | | | 15079 | 15095 | |
| | | | | | | 15222 | 15238 | |
| | | | | | | 15294 | 15310 | |
| | | | | | | 15353 | 15369 | |
| | | | | | | 15413 | 15429 | |
| | | | | | | 15485 | 15501 | |
| | | | | | | 15557 | 15573 | |
| | | | | | | 15615 | 15631 | |
| | | | | | | 15687 | 15703 | |
| | | | | | | 15817 | 15833 | |
| | | | | | | 15889 | 15905 | |
| | | | | | | 15947 | 15963 | |
| 548736 | n/a | n/a | TATCACTGTACTAGTTT | 4-10-3 | 21 | 14747 | 14763 | 1279 |
| | | | | | | 14818 | 14834 | |
| | | | | | | 14889 | 14905 | |
| | | | | | | 14948 | 14964 | |
| | | | | | | 15008 | 15024 | |
| | | | | | | 15080 | 15096 | |
| | | | | | | 15152 | 15168 | |
| | | | | | | 15223 | 15239 | |
| | | | | | | 15295 | 15311 | |
| | | | | | | 15354 | 15370 | |
| | | | | | | 15414 | 15430 | |
| | | | | | | 15486 | 15502 | |
| | | | | | | 15558 | 15574 | |
| | | | | | | 15616 | 15632 | |
| | | | | | | 15688 | 15704 | |
| | | | | | | 15818 | 15834 | |
| | | | | | | 15890 | 15906 | |
| | | | | | | 15948 | 15964 | |
| 548737 | n/a | n/a | ACTAGTTTCCTATAACT | 4-9-4 | 11 | 14738 | 14754 | 1270 |
| | | | | | | 14809 | 14825 | |
| | | | | | | 14880 | 14896 | |
| | | | | | | 14939 | 14955 | |
| | | | | | | 15071 | 15087 | |
| | | | | | | 15214 | 15230 | |
| | | | | | | 15286 | 15302 | |
| | | | | | | 15345 | 15361 | |
| | | | | | | 15477 | 15493 | |
| | | | | | | 15549 | 15565 | |
| | | | | | | 15607 | 15623 | |
| | | | | | | 15679 | 15695 | |
| | | | | | | 15750 | 15766 | |
| | | | | | | 15809 | 15825 | |
| | | | | | | 15881 | 15897 | |
| | | | | | | 15939 | 15955 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548738 | n/a | n/a | TACTAGTTTCCTATAAC | 4-9-4 | 0 | 14739 | 14755 | 1271 |
| | | | | | | 14810 | 14826 | |
| | | | | | | 14881 | 14897 | |
| | | | | | | 14940 | 14956 | |
| | | | | | | 15000 | 15016 | |
| | | | | | | 15072 | 15088 | |
| | | | | | | 15215 | 15231 | |
| | | | | | | 15287 | 15303 | |
| | | | | | | 15346 | 15362 | |
| | | | | | | 15406 | 15422 | |
| | | | | | | 15478 | 15494 | |
| | | | | | | 15550 | 15566 | |
| | | | | | | 15608 | 15624 | |
| | | | | | | 15680 | 15696 | |
| | | | | | | 15751 | 15767 | |
| | | | | | | 15810 | 15826 | |
| | | | | | | 15882 | 15898 | |
| | | | | | | 15940 | 15956 | |
| 548739 | n/a | n/a | GTACTAGTTTCCTATAA | 4-9-4 | 0 | 14740 | 14756 | 1272 |
| | | | | | | 14811 | 14827 | |
| | | | | | | 14882 | 14898 | |
| | | | | | | 14941 | 14957 | |
| | | | | | | 15001 | 15017 | |
| | | | | | | 15073 | 15089 | |
| | | | | | | 15216 | 15232 | |
| | | | | | | 15288 | 15304 | |
| | | | | | | 15347 | 15363 | |
| | | | | | | 15407 | 15423 | |
| | | | | | | 15479 | 15495 | |
| | | | | | | 15551 | 15567 | |
| | | | | | | 15609 | 15625 | |
| | | | | | | 15681 | 15697 | |
| | | | | | | 15752 | 15768 | |
| | | | | | | 15811 | 15827 | |
| | | | | | | 15883 | 15899 | |
| | | | | | | 15941 | 15957 | |
| 548740 | n/a | n/a | TGTACTAGTTTCCTATA | 4-9-4 | 0 | 14741 | 14757 | 1273 |
| | | | | | | 14812 | 14828 | |
| | | | | | | 14883 | 14899 | |
| | | | | | | 14942 | 14958 | |
| | | | | | | 15002 | 15018 | |
| | | | | | | 15074 | 15090 | |
| | | | | | | 15217 | 15233 | |
| | | | | | | 15289 | 15305 | |
| | | | | | | 15348 | 15364 | |
| | | | | | | 15408 | 15424 | |
| | | | | | | 15480 | 15496 | |
| | | | | | | 15552 | 15568 | |
| | | | | | | 15610 | 15626 | |
| | | | | | | 15682 | 15698 | |
| | | | | | | 15812 | 15828 | |
| | | | | | | 15884 | 15900 | |
| | | | | | | 15942 | 15958 | |
| 548741 | n/a | n/a | CTGTACTAGTTTCCTAT | 4-9-4 | 69 | 14742 | 14758 | 1274 |
| | | | | | | 14813 | 14829 | |
| | | | | | | 14884 | 14900 | |
| | | | | | | 14943 | 14959 | |
| | | | | | | 15003 | 15019 | |
| | | | | | | 15075 | 15091 | |
| | | | | | | 15218 | 15234 | |
| | | | | | | 15290 | 15306 | |
| | | | | | | 15349 | 15365 | |
| | | | | | | 15409 | 15425 | |
| | | | | | | 15481 | 15497 | |
| | | | | | | 15553 | 15569 | |
| | | | | | | 15611 | 15627 | |
| | | | | | | 15683 | 15699 | |
| | | | | | | 15813 | 15829 | |
| | | | | | | 15885 | 15901 | |
| | | | | | | 15943 | 15959 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548742 | n/a | n/a | ACTGTACTAGTTTCCTA | 4-9-4 | 50 | 14743 | 14759 | 1275 |
|  |  |  |  |  |  | 14814 | 14830 |  |
|  |  |  |  |  |  | 14885 | 14901 |  |
|  |  |  |  |  |  | 14944 | 14960 |  |
|  |  |  |  |  |  | 15004 | 15020 |  |
|  |  |  |  |  |  | 15076 | 15092 |  |
|  |  |  |  |  |  | 15219 | 15235 |  |
|  |  |  |  |  |  | 15291 | 15307 |  |
|  |  |  |  |  |  | 15350 | 15366 |  |
|  |  |  |  |  |  | 15410 | 15426 |  |
|  |  |  |  |  |  | 15482 | 15498 |  |
|  |  |  |  |  |  | 15554 | 15570 |  |
|  |  |  |  |  |  | 15612 | 15628 |  |
|  |  |  |  |  |  | 15684 | 15700 |  |
|  |  |  |  |  |  | 15814 | 15830 |  |
|  |  |  |  |  |  | 15886 | 15902 |  |
|  |  |  |  |  |  | 15944 | 15960 |  |
| 548743 | n/a | n/a | CACTGTACTAGTTTCCT | 4-9-4 | 80 | 14744 | 14760 | 1276 |
|  |  |  |  |  |  | 14815 | 14831 |  |
|  |  |  |  |  |  | 14886 | 14902 |  |
|  |  |  |  |  |  | 14945 | 14961 |  |
|  |  |  |  |  |  | 15005 | 15021 |  |
|  |  |  |  |  |  | 15077 | 15093 |  |
|  |  |  |  |  |  | 15220 | 15236 |  |
|  |  |  |  |  |  | 15292 | 15308 |  |
|  |  |  |  |  |  | 15351 | 15367 |  |
|  |  |  |  |  |  | 15411 | 15427 |  |
|  |  |  |  |  |  | 15483 | 15499 |  |
|  |  |  |  |  |  | 15555 | 15571 |  |
|  |  |  |  |  |  | 15613 | 15629 |  |
|  |  |  |  |  |  | 15685 | 15701 |  |
|  |  |  |  |  |  | 15815 | 15831 |  |
|  |  |  |  |  |  | 15887 | 15903 |  |
|  |  |  |  |  |  | 15945 | 15961 |  |
| 548744 | n/a | n/a | TCACTGTACTAGTTTCC | 4-9-4 | 83 | 14745 | 14761 | 1277 |
|  |  |  |  |  |  | 14816 | 14832 |  |
|  |  |  |  |  |  | 14887 | 14903 |  |
|  |  |  |  |  |  | 14946 | 14962 |  |
|  |  |  |  |  |  | 15006 | 15022 |  |
|  |  |  |  |  |  | 15078 | 15094 |  |
|  |  |  |  |  |  | 15221 | 15237 |  |
|  |  |  |  |  |  | 15293 | 15309 |  |
|  |  |  |  |  |  | 15352 | 15368 |  |
|  |  |  |  |  |  | 15412 | 15428 |  |
|  |  |  |  |  |  | 15484 | 15500 |  |
|  |  |  |  |  |  | 15556 | 15572 |  |
|  |  |  |  |  |  | 15614 | 15630 |  |
|  |  |  |  |  |  | 15686 | 15702 |  |
|  |  |  |  |  |  | 15816 | 15832 |  |
|  |  |  |  |  |  | 15888 | 15904 |  |
|  |  |  |  |  |  | 15946 | 15962 |  |
| 548745 | n/a | n/a | ATCACTGTACTAGTTTC | 4-9-4 | 71 | 14746 | 14762 | 1278 |
|  |  |  |  |  |  | 14817 | 14833 |  |
|  |  |  |  |  |  | 14888 | 14904 |  |
|  |  |  |  |  |  | 14947 | 14963 |  |
|  |  |  |  |  |  | 15007 | 15023 |  |
|  |  |  |  |  |  | 15079 | 15095 |  |
|  |  |  |  |  |  | 15222 | 15238 |  |
|  |  |  |  |  |  | 15294 | 15310 |  |
|  |  |  |  |  |  | 15353 | 15369 |  |
|  |  |  |  |  |  | 15413 | 15429 |  |
|  |  |  |  |  |  | 15485 | 15501 |  |
|  |  |  |  |  |  | 15557 | 15573 |  |
|  |  |  |  |  |  | 15615 | 15631 |  |
|  |  |  |  |  |  | 15687 | 15703 |  |
|  |  |  |  |  |  | 15817 | 15833 |  |
|  |  |  |  |  |  | 15889 | 15905 |  |
|  |  |  |  |  |  | 15947 | 15963 |  |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548746 | n/a | n/a | TATCACTGTACTAGTTT | 4-9-4 | 40 | 14747 | 14763 | 1279 |
|  |  |  |  |  |  | 14818 | 14834 |  |
|  |  |  |  |  |  | 14889 | 14905 |  |
|  |  |  |  |  |  | 14948 | 14964 |  |
|  |  |  |  |  |  | 15008 | 15024 |  |
|  |  |  |  |  |  | 15080 | 15096 |  |
|  |  |  |  |  |  | 15152 | 15168 |  |
|  |  |  |  |  |  | 15223 | 15239 |  |
|  |  |  |  |  |  | 15295 | 15311 |  |
|  |  |  |  |  |  | 15354 | 15370 |  |
|  |  |  |  |  |  | 15414 | 15430 |  |
|  |  |  |  |  |  | 15486 | 15502 |  |
|  |  |  |  |  |  | 15558 | 15574 |  |
|  |  |  |  |  |  | 15616 | 15632 |  |
|  |  |  |  |  |  | 15688 | 15704 |  |
|  |  |  |  |  |  | 15818 | 15834 |  |
|  |  |  |  |  |  | 15890 | 15906 |  |
|  |  |  |  |  |  | 15948 | 15964 |  |
| 548747 | n/a | n/a | TACTAGTTTCCTATAACT | 4-10-4 | 2 | 14738 | 14755 | 1280 |
|  |  |  |  |  |  | 14809 | 14826 |  |
|  |  |  |  |  |  | 14880 | 14897 |  |
|  |  |  |  |  |  | 14939 | 14956 |  |
|  |  |  |  |  |  | 15071 | 15088 |  |
|  |  |  |  |  |  | 15214 | 15231 |  |
|  |  |  |  |  |  | 15286 | 15303 |  |
|  |  |  |  |  |  | 15345 | 15362 |  |
|  |  |  |  |  |  | 15477 | 15494 |  |
|  |  |  |  |  |  | 15549 | 15566 |  |
|  |  |  |  |  |  | 15607 | 15624 |  |
|  |  |  |  |  |  | 15679 | 15696 |  |
|  |  |  |  |  |  | 15750 | 15767 |  |
|  |  |  |  |  |  | 15809 | 15826 |  |
|  |  |  |  |  |  | 15881 | 15898 |  |
|  |  |  |  |  |  | 15939 | 15956 |  |
| 548748 | n/a | n/a | GTACTAGTTTCCTATAAC | 4-10-4 | 0 | 14739 | 14756 | 1281 |
|  |  |  |  |  |  | 14810 | 14827 |  |
|  |  |  |  |  |  | 14881 | 14898 |  |
|  |  |  |  |  |  | 14940 | 14957 |  |
|  |  |  |  |  |  | 15000 | 15017 |  |
|  |  |  |  |  |  | 15072 | 15089 |  |
|  |  |  |  |  |  | 15215 | 15232 |  |
|  |  |  |  |  |  | 15287 | 15304 |  |
|  |  |  |  |  |  | 15346 | 15363 |  |
|  |  |  |  |  |  | 15406 | 15423 |  |
|  |  |  |  |  |  | 15478 | 15495 |  |
|  |  |  |  |  |  | 15550 | 15567 |  |
|  |  |  |  |  |  | 15608 | 15625 |  |
|  |  |  |  |  |  | 15680 | 15697 |  |
|  |  |  |  |  |  | 15751 | 15768 |  |
|  |  |  |  |  |  | 15810 | 15827 |  |
|  |  |  |  |  |  | 15882 | 15899 |  |
|  |  |  |  |  |  | 15940 | 15957 |  |
| 548749 | n/a | n/a | TGTACTAGTTTCCTATAA | 4-10-4 | 0 | 14740 | 14757 | 1282 |
|  |  |  |  |  |  | 14811 | 14828 |  |
|  |  |  |  |  |  | 14882 | 14899 |  |
|  |  |  |  |  |  | 14941 | 14958 |  |
|  |  |  |  |  |  | 15001 | 15018 |  |
|  |  |  |  |  |  | 15073 | 15090 |  |
|  |  |  |  |  |  | 15216 | 15233 |  |
|  |  |  |  |  |  | 15288 | 15305 |  |
|  |  |  |  |  |  | 15347 | 15364 |  |
|  |  |  |  |  |  | 15407 | 15424 |  |
|  |  |  |  |  |  | 15479 | 15496 |  |
|  |  |  |  |  |  | 15551 | 15568 |  |
|  |  |  |  |  |  | 15609 | 15626 |  |
|  |  |  |  |  |  | 15681 | 15698 |  |
|  |  |  |  |  |  | 15811 | 15828 |  |
|  |  |  |  |  |  | 15883 | 15900 |  |
|  |  |  |  |  |  | 15941 | 15958 |  |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548750 | n/a | n/a | CTGTACTAGTTTCCTATA | 4-10-4 | 62 | 14741 | 14758 | 1283 |
| | | | | | | 14812 | 14829 | |
| | | | | | | 14883 | 14900 | |
| | | | | | | 14942 | 14959 | |
| | | | | | | 15002 | 15019 | |
| | | | | | | 15074 | 15091 | |
| | | | | | | 15217 | 15234 | |
| | | | | | | 15289 | 15306 | |
| | | | | | | 15348 | 15365 | |
| | | | | | | 15408 | 15425 | |
| | | | | | | 15480 | 15497 | |
| | | | | | | 15552 | 15569 | |
| | | | | | | 15610 | 15627 | |
| | | | | | | 15682 | 15699 | |
| | | | | | | 15812 | 15829 | |
| | | | | | | 15884 | 15901 | |
| | | | | | | 15942 | 15959 | |
| 548751 | n/a | n/a | ACTGTACTAGTTTCCTAT | 4-10-4 | 53 | 14742 | 14759 | 1284 |
| | | | | | | 14813 | 14830 | |
| | | | | | | 14884 | 14901 | |
| | | | | | | 14943 | 14960 | |
| | | | | | | 15003 | 15020 | |
| | | | | | | 15075 | 15092 | |
| | | | | | | 15218 | 15235 | |
| | | | | | | 15290 | 15307 | |
| | | | | | | 15349 | 15366 | |
| | | | | | | 15409 | 15426 | |
| | | | | | | 15481 | 15498 | |
| | | | | | | 15553 | 15570 | |
| | | | | | | 15611 | 15628 | |
| | | | | | | 15683 | 15700 | |
| | | | | | | 15813 | 15830 | |
| | | | | | | 15885 | 15902 | |
| | | | | | | 15943 | 15960 | |
| 548752 | n/a | n/a | CACTGTACTAGTTTCCTA | 4-10-4 | 89 | 14743 | 14760 | 1285 |
| | | | | | | 14814 | 14831 | |
| | | | | | | 14885 | 14902 | |
| | | | | | | 14944 | 14961 | |
| | | | | | | 15004 | 15021 | |
| | | | | | | 15076 | 15093 | |
| | | | | | | 15219 | 15236 | |
| | | | | | | 15291 | 15308 | |
| | | | | | | 15350 | 15367 | |
| | | | | | | 15410 | 15427 | |
| | | | | | | 15482 | 15499 | |
| | | | | | | 15554 | 15571 | |
| | | | | | | 15612 | 15629 | |
| | | | | | | 15684 | 15701 | |
| | | | | | | 15814 | 15831 | |
| | | | | | | 15886 | 15903 | |
| | | | | | | 15944 | 15961 | |
| 548753 | n/a | n/a | TCACTGTACTAGTTTCCT | 4-10-4 | 82 | 14744 | 14761 | 1286 |
| | | | | | | 14815 | 14832 | |
| | | | | | | 14886 | 14903 | |
| | | | | | | 14945 | 14962 | |
| | | | | | | 15005 | 15022 | |
| | | | | | | 15077 | 15094 | |
| | | | | | | 15220 | 15237 | |
| | | | | | | 15292 | 15309 | |
| | | | | | | 15351 | 15368 | |
| | | | | | | 15411 | 15428 | |
| | | | | | | 15483 | 15500 | |
| | | | | | | 15555 | 15572 | |
| | | | | | | 15613 | 15630 | |
| | | | | | | 15685 | 15702 | |
| | | | | | | 15815 | 15832 | |
| | | | | | | 15887 | 15904 | |
| | | | | | | 15945 | 15962 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548754 | n/a | n/a | ATCACTGTACTAGTTTCC | 4-10-4 | 77 | 14745 | 14762 | 1287 |
| | | | | | | 14816 | 14833 | |
| | | | | | | 14887 | 14904 | |
| | | | | | | 14946 | 14963 | |
| | | | | | | 15006 | 15023 | |
| | | | | | | 15078 | 15095 | |
| | | | | | | 15221 | 15238 | |
| | | | | | | 15293 | 15310 | |
| | | | | | | 15352 | 15369 | |
| | | | | | | 15412 | 15429 | |
| | | | | | | 15484 | 15501 | |
| | | | | | | 15556 | 15573 | |
| | | | | | | 15614 | 15631 | |
| | | | | | | 15686 | 15703 | |
| | | | | | | 15816 | 15833 | |
| | | | | | | 15888 | 15905 | |
| | | | | | | 15946 | 15963 | |
| 548755 | n/a | n/a | TATCACTGTACTAGTTTC | 4-10-4 | 20 | 14746 | 14763 | 1288 |
| | | | | | | 14817 | 14834 | |
| | | | | | | 14888 | 14905 | |
| | | | | | | 14947 | 14964 | |
| | | | | | | 15007 | 15024 | |
| | | | | | | 15079 | 15096 | |
| | | | | | | 15222 | 15239 | |
| | | | | | | 15294 | 15311 | |
| | | | | | | 15353 | 15370 | |
| | | | | | | 15413 | 15430 | |
| | | | | | | 15485 | 15502 | |
| | | | | | | 15557 | 15574 | |
| | | | | | | 15615 | 15632 | |
| | | | | | | 15687 | 15704 | |
| | | | | | | 15817 | 15834 | |
| | | | | | | 15889 | 15906 | |
| | | | | | | 15947 | 15964 | |
| 548756 | n/a | n/a | GTATCACTGTACTAGTT | 4-9-4 | 81 | 14748 | 14764 | 1289 |
| | | | | | | 14819 | 14835 | |
| | | | | | | 14890 | 14906 | |
| | | | | | | 14949 | 14965 | |
| | | | | | | 15009 | 15025 | |
| | | | | | | 15081 | 15097 | |
| | | | | | | 15153 | 15169 | |
| | | | | | | 15224 | 15240 | |
| | | | | | | 15296 | 15312 | |
| | | | | | | 15355 | 15371 | |
| | | | | | | 15415 | 15431 | |
| | | | | | | 15487 | 15503 | |
| | | | | | | 15559 | 15575 | |
| | | | | | | 15617 | 15633 | |
| | | | | | | 15689 | 15705 | |
| | | | | | | 15819 | 15835 | |
| | | | | | | 15891 | 15907 | |
| | | | | | | 15949 | 15965 | |
| 548757 | n/a | n/a | AGTATCACTGTACTAGT | 4-9-4 | 87 | 14749 | 14765 | 1290 |
| | | | | | | 14820 | 14836 | |
| | | | | | | 14891 | 14907 | |
| | | | | | | 14950 | 14966 | |
| | | | | | | 15010 | 15026 | |
| | | | | | | 15082 | 15098 | |
| | | | | | | 15154 | 15170 | |
| | | | | | | 15225 | 15241 | |
| | | | | | | 15297 | 15313 | |
| | | | | | | 15356 | 15372 | |
| | | | | | | 15416 | 15432 | |
| | | | | | | 15488 | 15504 | |
| | | | | | | 15560 | 15576 | |
| | | | | | | 15618 | 15634 | |
| | | | | | | 15690 | 15706 | |
| | | | | | | 15820 | 15836 | |
| | | | | | | 15892 | 15908 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| | | | | | | 15950 | 15966 | |
| 548758 | n/a | n/a | CAGTATCACTGTACTAG | 4-9-4 | 97 | 14750 | 14766 | 1291 |
| | | | | | | 14821 | 14837 | |
| | | | | | | 14892 | 14908 | |
| | | | | | | 14951 | 14967 | |
| | | | | | | 15011 | 15027 | |
| | | | | | | 15083 | 15099 | |
| | | | | | | 15155 | 15171 | |
| | | | | | | 15226 | 15242 | |
| | | | | | | 15298 | 15314 | |
| | | | | | | 15357 | 15373 | |
| | | | | | | 15417 | 15433 | |
| | | | | | | 15489 | 15505 | |
| | | | | | | 15561 | 15577 | |
| | | | | | | 15619 | 15635 | |
| | | | | | | 15691 | 15707 | |
| | | | | | | 15821 | 15837 | |
| | | | | | | 15893 | 15909 | |
| | | | | | | 15951 | 15967 | |
| 548759 | n/a | n/a | AACAGTATCACTGTACT | 4-9-4 | 68 | 14752 | 14768 | 1292 |
| | | | | | | 14823 | 14839 | |
| | | | | | | 14894 | 14910 | |
| | | | | | | 14953 | 14969 | |
| | | | | | | 15013 | 15029 | |
| | | | | | | 15085 | 15101 | |
| | | | | | | 15157 | 15173 | |
| | | | | | | 15228 | 15244 | |
| | | | | | | 15300 | 15316 | |
| | | | | | | 15359 | 15375 | |
| | | | | | | 15419 | 15435 | |
| | | | | | | 15491 | 15507 | |
| | | | | | | 15563 | 15579 | |
| | | | | | | 15621 | 15637 | |
| | | | | | | 15693 | 15709 | |
| | | | | | | 15823 | 15839 | |
| | | | | | | 15895 | 15911 | |
| | | | | | | 15953 | 15969 | |
| 548760 | n/a | n/a | TAACAGTATCACTGTAC | 4-9-4 | 53 | 14753 | 14769 | 1293 |
| | | | | | | 14824 | 14840 | |
| | | | | | | 14895 | 14911 | |
| | | | | | | 14954 | 14970 | |
| | | | | | | 15014 | 15030 | |
| | | | | | | 15086 | 15102 | |
| | | | | | | 15158 | 15174 | |
| | | | | | | 15229 | 15245 | |
| | | | | | | 15301 | 15317 | |
| | | | | | | 15360 | 15376 | |
| | | | | | | 15420 | 15436 | |
| | | | | | | 15492 | 15508 | |
| | | | | | | 15564 | 15580 | |
| | | | | | | 15622 | 15638 | |
| | | | | | | 15694 | 15710 | |
| | | | | | | 15824 | 15840 | |
| | | | | | | 15896 | 15912 | |
| | | | | | | 15954 | 15970 | |
| 548761 | n/a | n/a | CTAACAGTATCACTGTA | 4-9-4 | 49 | 14754 | 14770 | 1294 |
| | | | | | | 14825 | 14841 | |
| | | | | | | 14896 | 14912 | |
| | | | | | | 15015 | 15031 | |
| | | | | | | 15087 | 15103 | |
| | | | | | | 15230 | 15246 | |
| | | | | | | 15302 | 15318 | |
| | | | | | | 15421 | 15437 | |
| | | | | | | 15493 | 15509 | |
| | | | | | | 15623 | 15639 | |
| | | | | | | 15825 | 15841 | |
| | | | | | | 15955 | 15971 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548762 | n/a | n/a | TCTAACAGTATCACTGT | 4-9-4 | 16 | 14755 | 14771 | 1295 |
| | | | | | | 14826 | 14842 | |
| | | | | | | 14897 | 14913 | |
| | | | | | | 15016 | 15032 | |
| | | | | | | 15088 | 15104 | |
| | | | | | | 15231 | 15247 | |
| | | | | | | 15303 | 15319 | |
| | | | | | | 15422 | 15438 | |
| | | | | | | 15494 | 15510 | |
| | | | | | | 15624 | 15640 | |
| | | | | | | 15826 | 15842 | |
| | | | | | | 15956 | 15972 | |
| 548763 | n/a | n/a | CTCTAACAGTATCACTG | 4-9-4 | 44 | 14756 | 14772 | 1296 |
| | | | | | | 14827 | 14843 | |
| | | | | | | 14898 | 14914 | |
| | | | | | | 15017 | 15033 | |
| | | | | | | 15089 | 15105 | |
| | | | | | | 15232 | 15248 | |
| | | | | | | 15304 | 15320 | |
| | | | | | | 15423 | 15439 | |
| | | | | | | 15495 | 15511 | |
| | | | | | | 15625 | 15641 | |
| | | | | | | 15827 | 15843 | |
| | | | | | | 15957 | 15973 | |
| 548764 | n/a | n/a | TATCACTGTCCTATAAC | 4-9-4 | 31 | 14772 | 14788 | 1297 |
| | | | | | | 14843 | 14859 | |
| | | | | | | 15177 | 15193 | |
| | | | | | | 15583 | 15599 | |
| | | | | | | 15713 | 15729 | |
| | | | | | | 16012 | 16028 | |
| | | | | | | 16083 | 16099 | |
| | | | | | | 16161 | 16177 | |
| | | | | | | 16180 | 16196 | |
| | | | | | | 16231 | 16247 | |
| 548765 | n/a | n/a | ATATCACTGTCCTATAA | 4-9-4 | 0 | 14773 | 14789 | 1298 |
| | | | | | | 14844 | 14860 | |
| | | | | | | 15178 | 15194 | |
| | | | | | | 15584 | 15600 | |
| | | | | | | 15714 | 15730 | |
| | | | | | | 16013 | 16029 | |
| | | | | | | 16084 | 16100 | |
| | | | | | | 16162 | 16178 | |
| | | | | | | 16181 | 16197 | |
| | | | | | | 16232 | 16248 | |
| 548766 | n/a | n/a | TATATCACTGTCCTATA | 4-9-4 | 36 | 14774 | 14790 | 1299 |
| | | | | | | 14845 | 14861 | |
| | | | | | | 15179 | 15195 | |
| | | | | | | 15715 | 15731 | |
| | | | | | | 16163 | 16179 | |
| 548767 | n/a | n/a | TATCACTGTCCTATATC | 4-9-4 | 59 | 14785 | 14801 | 1300 |
| | | | | | | 14856 | 14872 | |
| | | | | | | 14981 | 14997 | |
| | | | | | | 15119 | 15135 | |
| | | | | | | 15190 | 15206 | |
| | | | | | | 15262 | 15278 | |
| | | | | | | 15387 | 15403 | |
| | | | | | | 15525 | 15541 | |
| | | | | | | 15655 | 15671 | |
| | | | | | | 15726 | 15742 | |
| | | | | | | 15857 | 15873 | |
| | | | | | | 15987 | 16003 | |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548768 | n/a | n/a | GTATCACTGTCCTATAT | 4-9-4 | 56 | 14786<br>14982<br>15120<br>15388<br>15526<br>15988 | 14802<br>14998<br>15136<br>15404<br>15542<br>16004 | 1301 |
| 548769 | n/a | n/a | AGTATCACTGTCCTATA | 4-9-4 | 64 | 14787<br>14983<br>15121<br>15389<br>15527<br>15989 | 14803<br>14999<br>15137<br>15405<br>15543<br>16005 | 1302 |
| 548770 | n/a | n/a | TAACAGTATCACTGTCC | 4-9-4 | 92 | 14791<br>14987<br>15053<br>15125<br>15393<br>15459<br>15531<br>15993 | 14807<br>15003<br>15069<br>15141<br>15409<br>15475<br>15547<br>16009 | 1303 |
| 548771 | n/a | n/a | ATAACAGTATCACTGTC | 4-9-4 | 62 | 14792<br>14988<br>15054<br>15126<br>15394<br>15460<br>15532<br>15994 | 14808<br>15004<br>15070<br>15142<br>15410<br>15476<br>15548<br>16010 | 1304 |
| 548772 | n/a | n/a | TATAACAGTATCACTGT | 4-9-4 | 0 | 14793<br>14989<br>15055<br>15127<br>15160<br>15362<br>15395<br>15461<br>15533<br>15566<br>15696<br>15898<br>15995 | 14809<br>15005<br>15071<br>15143<br>15176<br>15378<br>15411<br>15477<br>15549<br>15582<br>15712<br>15914<br>16011 | 1305 |
| 548773 | n/a | n/a | CTATAACAGTATCACTG | 4-9-4 | 0 | 14794<br>14990<br>15056<br>15128<br>15161<br>15363<br>15396<br>15462<br>15534<br>15567<br>15697<br>15899<br>15996 | 14810<br>15006<br>15072<br>15144<br>15177<br>15379<br>15412<br>15478<br>15550<br>15583<br>15713<br>15915<br>16012 | 1306 |
| 548774 | n/a | n/a | CCTATAACTATAACAGT | 4-9-4 | 0 | 14801<br>15063<br>15168<br>15469<br>15541<br>15574<br>15704<br>15775<br>16003 | 14817<br>15079<br>15184<br>15485<br>15557<br>15590<br>15720<br>15791<br>16019 | 1307 |

TABLE 139-continued

| ISIS NO | SEQ ID NO: 1 Start Site | SEQ ID NO: 1 Stop Site | Sequence | Motif | % inhibition | SEQ ID NO: 10 Start Site | SEQ ID NO: 10 Stop Site | SEQ ID NO |
|---|---|---|---|---|---|---|---|---|
| 548775 | n/a | n/a | TCCTATAACTATAACAG | 4-9-4 | 0 | 14802 | 14818 | 1308 |
| | | | | | | 15064 | 15080 | |
| | | | | | | 15169 | 15185 | |
| | | | | | | 15470 | 15486 | |
| | | | | | | 15542 | 15558 | |
| | | | | | | 15575 | 15591 | |
| | | | | | | 15705 | 15721 | |
| | | | | | | 16004 | 16020 | |
| 548776 | n/a | n/a | CCTATAACTATAACAAT | 4-9-4 | 0 | 14872 | 14888 | 1309 |
| | | | | | | 14931 | 14947 | |
| | | | | | | 15206 | 15222 | |
| | | | | | | 15278 | 15294 | |
| | | | | | | 15337 | 15353 | |
| | | | | | | 15599 | 15615 | |
| | | | | | | 15671 | 15687 | |
| | | | | | | 15742 | 15758 | |
| | | | | | | 15801 | 15817 | |
| | | | | | | 15873 | 15889 | |
| | | | | | | 15931 | 15947 | |
| | | | | | | 16074 | 16090 | |
| | | | | | | 16099 | 16115 | |
| | | | | | | 16152 | 16168 | |
| | | | | | | 16247 | 16263 | |
| 548777 | n/a | n/a | GTAACAGTATCACTGTA | 4-9-4 | 41 | 14955 | 14971 | 1310 |
| 548778 | n/a | n/a | ATAACAGTATCACTGTA | 4-9-4 | 20 | 15159 | 15175 | 1311 |
| | | | | | | 15361 | 15377 | |
| | | | | | | 15565 | 15581 | |
| | | | | | | 15695 | 15711 | |
| | | | | | | 15897 | 15913 | |
| 548779 | n/a | n/a | GTCCTATAACTATAACA | 4-9-4 | 0 | 15170 | 15186 | 1312 |
| | | | | | | 15576 | 15592 | |
| | | | | | | 15706 | 15722 | |
| | | | | | | 16005 | 16021 | |
| | | | | | | 16076 | 16092 | |
| | | | | | | 16101 | 16117 | |
| | | | | | | 16154 | 16170 | |
| 548780 | n/a | n/a | TGTCCTATAACTATAAC | 4-9-4 | 22 | 15171 | 15187 | 1313 |
| | | | | | | 15577 | 15593 | |
| | | | | | | 15707 | 15723 | |
| | | | | | | 16006 | 16022 | |
| | | | | | | 16077 | 16093 | |
| | | | | | | 16102 | 16118 | |
| | | | | | | 16155 | 16171 | |
| 548781 | n/a | n/a | ACCTATAACTATAACAG | 4-9-4 | 0 | 15776 | 15792 | 1314 |
| 548782 | n/a | n/a | TACCTATAACTATAACA | 4-9-4 | 0 | 15777 | 15793 | 1315 |
| | | | | | | 16249 | 16265 | |
| 548783 | n/a | n/a | ACCTATAACTATAACAA | 4-9-4 | 0 | 16248 | 16264 | 1316 |

Example 116

Antisense Inhibition of Human PKK in HepaRG™ Cells by Antisense Oligonucleotides with MOE, Deoxy and cEt Sugar Modifications Additional antisense oligonucleotides were designed targeting a PKK nucleic acid and were tested for their effects on PKK mRNA in vitro.

The chimeric antisense oligonucleotides in the tables below were designed as deoxy, MOE and cEt gapmers. The gapmers are 16 nucleosides in length wherein the nucleoside have either a MOE sugar modification, a cEt sugar modification, or a deoxy modification. The 'Chemistry' column describes the sugar modifications of each oligonucleotide. 'k' indicates an cEt sugar modification; the number indicates the number of deoxynucleosides; otherwise, 'd' indicates a deoxynucleoside; and 'e' indicates a 2'-O-methoxyethyl modification. The internucleoside linkages throughout each gapmer are phosphorothioate linkages. All cytosine residues throughout each oligonucleotide are 5-methylcytosines. "Start site" indicates the 5'-most nucleoside to which the gapmer is targeted in the human gene sequence. "Stop site" indicates the 3'-most nucleoside to which the gapmer is targeted in the human gene sequence. Each gapmer listed in the tables below is targeted to either the human PKK mRNA, designated herein as SEQ ID NO: 1 or the human PKK genomic sequence, designated herein as SEQ ID NO: 10. 'n/a' indicates that the antisense oligonucleotide does not target that particular gene sequence.

Cultured HepaRG™ cells at a density of 20,000 cells per well were transfected using electroporation with 1,000 nM antisense oligonucleotide. After a treatment period of approximately 24 hours, RNA was isolated from the cells and PKK mRNA levels were measured by quantitative real-time PCR. Human primer probe set RTS3454 was used to measure mRNA levels. ISIS 531231 was also included in this assay. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells.

TABLE 140

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547747 | n/a | n/a | TCACTGTACTAGTTTC | eekd$_{10}$kke | 95 | 14746 | 14761 | 1267 |
|  |  |  |  |  |  | 14817 | 14832 |  |
|  |  |  |  |  |  | 14888 | 14903 |  |
|  |  |  |  |  |  | 14947 | 14962 |  |
|  |  |  |  |  |  | 15007 | 15022 |  |
|  |  |  |  |  |  | 15079 | 15094 |  |
|  |  |  |  |  |  | 15222 | 15237 |  |
|  |  |  |  |  |  | 15294 | 15309 |  |
|  |  |  |  |  |  | 15353 | 15368 |  |
|  |  |  |  |  |  | 15413 | 15428 |  |
|  |  |  |  |  |  | 15485 | 15500 |  |
|  |  |  |  |  |  | 15557 | 15572 |  |
|  |  |  |  |  |  | 15615 | 15630 |  |
|  |  |  |  |  |  | 15687 | 15702 |  |
|  |  |  |  |  |  | 15817 | 15832 |  |
|  |  |  |  |  |  | 15889 | 15904 |  |
|  |  |  |  |  |  | 15947 | 15962 |  |
| 548074 | 1642 | 1657 | CCTTTCTCCTTCGAGA | eekd$_{10}$kke | 0 | 31948 | 31963 | 1317 |
| 548075 | 1643 | 1658 | ACCTTTCTCCTTCGAG | eekd$_{10}$kke | 0 | 31949 | 31964 | 1318 |
| 548076 | 1644 | 1659 | CACCTTTCTCCTTCGA | eekd$_{10}$kke | 26 | n/a | n/a | 1319 |
| 548077 | 1691 | 1706 | ATTTGTTACCAAAGGA | eekd$_{10}$kke | 51 | 33135 | 33150 | 1320 |
| 548078 | 1696 | 1711 | TCTTCATTTGTTACCA | eekd$_{10}$kke | 36 | 33140 | 33155 | 1321 |
| 548079 | 1762 | 1777 | CCTTCTTTATAGCCAG | eekd$_{10}$kke | 39 | 33206 | 33221 | 1322 |
| 548080 | 1763 | 1778 | CCCTTCTTTATAGCCA | eekd$_{10}$kke | 0 | 33207 | 33222 | 1323 |
| 548081 | 1764 | 1779 | CCCCTTCTTTATAGCC | eekd$_{10}$kke | 64 | 33208 | 33223 | 1324 |
| 548082 | 1776 | 1791 | AAGCATCTTTTCCCCC | eekd$_{10}$kke | 42 | 33220 | 33235 | 1325 |
| 548083 | 1800 | 1815 | AGGGACCACCTGAATC | eekd$_{10}$kke | 0 | 33899 | 33914 | 1326 |
| 548084 | 1801 | 1816 | AAGGGACCACCTGAAT | eekd$_{10}$kke | 0 | 33900 | 33915 | 1327 |
| 548085 | 1802 | 1817 | TAAGGGACCACCTGAA | eekd$_{10}$kke | 8 | 33901 | 33916 | 1328 |
| 548086 | 1803 | 1818 | CTAAGGGACCACCTGA | eekd$_{10}$kke | 36 | 33902 | 33917 | 1329 |
| 548087 | 1804 | 1819 | ACTAAGGGACCACCTG | eekd$_{10}$kke | 24 | 33903 | 33918 | 1330 |
| 548088 | 1805 | 1820 | AACTAAGGGACCACCT | eekd$_{10}$kke | 27 | 33904 | 33919 | 1331 |
| 548089 | 1806 | 1821 | AAACTAAGGGACCACC | eekd$_{10}$kke | 34 | 33905 | 33920 | 1332 |

TABLE 140-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548090 | 1807 | 1822 | CAAACTAAGGGACCAC | eekd$_{10}$kke | 46 | 33906 | 33921 | 1333 |
| 548091 | 1809 | 1824 | TGCAAACTAAGGGACC | eekd$_{10}$kke | 62 | 33908 | 33923 | 1334 |
| 548092 | 1810 | 1825 | TTGCAAACTAAGGGAC | eekd$_{10}$kke | 30 | 33909 | 33924 | 1335 |
| 548093 | 1811 | 1826 | TTTGCAAACTAAGGGA | eekd$_{10}$kke | 0 | 33910 | 33925 | 1336 |
| 548094 | 1812 | 1827 | GTTTGCAAACTAAGGG | eekd$_{10}$kke | 74 | 33911 | 33926 | 1337 |
| 548095 | 1813 | 1828 | TGTTTGCAAACTAAGG | eekd$_{10}$kke | 35 | 33912 | 33927 | 1338 |
| 548096 | 1814 | 1829 | GTGTTTGCAAACTAAG | eekd$_{10}$kke | 23 | 33913 | 33928 | 1339 |
| 548097 | 1876 | 1891 | TGCTCCCTGCGGGCAC | eekd$_{10}$kke | 2 | 33975 | 33990 | 1340 |
| 548098 | 1887 | 1902 | AGACACCAGGTTGCTC | eekd$_{10}$kke | 0 | 33986 | 34001 | 1341 |
| 548099 | 1904 | 1919 | CTCAGCGACTTTGGTG | eekd$_{10}$kke | 55 | 34003 | 34018 | 1342 |
| 548100 | 1905 | 1920 | ACTCAGCGACTTTGGT | eekd$_{10}$kke | 25 | 34004 | 34019 | 1343 |
| 548101 | 1906 | 1921 | TACTCAGCGACTTTGG | eekd$_{10}$kke | 47 | 34005 | 34020 | 1344 |
| 548102 | 1907 | 1922 | GTACTCAGCGACTTTG | eekd$_{10}$kke | 58 | 34006 | 34021 | 1345 |
| 548103 | 1908 | 1923 | TGTACTCAGCGACTTT | eekd$_{10}$kke | 66 | 34007 | 34022 | 1346 |
| 548104 | 1909 | 1924 | ATGTACTCAGCGACTT | eekd$_{10}$kke | 59 | 34008 | 34023 | 1347 |
| 548105 | 1910 | 1925 | CATGTACTCAGCGACT | eekd$_{10}$kke | 49 | 34009 | 34024 | 1348 |
| 548106 | 1911 | 1926 | CCATGTACTCAGCGAC | eekd$_{10}$kke | 79 | 34010 | 34025 | 1349 |
| 548107 | 1912 | 1927 | TCCATGTACTCAGCGA | eekd$_{10}$kke | 76 | 34011 | 34026 | 1350 |
| 548108 | 1953 | 1968 | GAGCTTTTCCATCACT | eekd$_{10}$kke | 61 | 34052 | 34067 | 1351 |
| 548109 | 1959 | 1974 | GCATCTGAGCTTTTCC | eekd$_{10}$kke | 77 | 34058 | 34073 | 1352 |
| 548110 | 1960 | 1975 | TGCATCTGAGCTTTTC | eekd$_{10}$kke | 62 | 34059 | 34074 | 1353 |
| 548111 | 1963 | 1978 | GACTGCATCTGAGCTT | eekd$_{10}$kke | 53 | 34062 | 34077 | 1354 |
| 548112 | 1965 | 1980 | GTGACTGCATCTGAGC | eekd$_{10}$kke | 23 | 34064 | 34079 | 1355 |
| 548113 | 1966 | 1981 | GGTGACTGCATCTGAG | eekd$_{10}$kke | 56 | 34065 | 34080 | 1356 |
| 548114 | 1967 | 1982 | TGGTGACTGCATCTGA | eekd$_{10}$kke | 70 | 34066 | 34081 | 1357 |
| 548115 | 1972 | 1987 | CATGCTGGTGACTGCA | eekd$_{10}$kke | 76 | 34071 | 34086 | 1358 |
| 548116 | 1973 | 1988 | TCATGCTGGTGACTGC | eekd$_{10}$kke | 3 | 34072 | 34087 | 1359 |
| 548117 | 1974 | 1989 | CTCATGCTGGTGACTG | eekd$_{10}$kke | 73 | 34073 | 34088 | 1360 |
| 548118 | 1975 | 1990 | TCTCATGCTGGTGACT | eekd$_{10}$kke | 47 | 34074 | 34089 | 1361 |
| 548119 | 1984 | 1999 | TGGACTGCTTCTCATG | eekd$_{10}$kke | 25 | 34083 | 34098 | 1362 |
| 548121 | 1986 | 2001 | TCTGGACTGCTTCTCA | eekd$_{10}$kke | 64 | 34085 | 34100 | 1363 |
| 548122 | 1987 | 2002 | CTCTGGACTGCTTCTC | eekd$_{10}$kke | 55 | 34086 | 34101 | 1364 |
| 548123 | 1990 | 2005 | AGACTCTGGACTGCTT | eekd$_{10}$kke | 49 | 34089 | 34104 | 1365 |
| 548124 | 1991 | 2006 | TAGACTCTGGACTGCT | eekd$_{10}$kke | 51 | 34090 | 34105 | 1366 |
| 548125 | 1992 | 2007 | CTAGACTCTGGACTGC | eekd$_{10}$kke | 89 | 34091 | 34106 | 1367 |
| 548126 | 1995 | 2010 | TGCCTAGACTCTGGAC | eekd$_{10}$kke | 19 | 34094 | 34109 | 1368 |
| 548127 | 1996 | 2011 | TTGCCTAGACTCTGGA | eekd$_{10}$kke | 60 | 34095 | 34110 | 1369 |

TABLE 140-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548128 | 1997 | 2012 | ATTGCCTAGACTCTGG | eekd$_{10}$kke | 55 | 34096 | 34111 | 1370 |
| 548129 | 2022 | 2037 | TTTGACTTGAACTCAG | eekd$_{10}$kke | 35 | 34121 | 34136 | 1371 |
| 548130 | 2023 | 2038 | ATTTGACTTGAACTCA | eekd$_{10}$kke | 27 | 34122 | 34137 | 1372 |
| 548131 | 2024 | 2039 | AATTTGACTTGAACTC | eekd$_{10}$kke | 45 | 34123 | 34138 | 1373 |
| 548132 | 2025 | 2040 | GAATTTGACTTGAACT | eekd$_{10}$kke | 0 | 34124 | 34139 | 1374 |
| 548133 | 2026 | 2041 | AGAATTTGACTTGAAC | eekd$_{10}$kke | 23 | 34125 | 34140 | 1375 |
| 548134 | 2027 | 2042 | CAGAATTTGACTTGAA | eekd$_{10}$kke | 17 | 34126 | 34141 | 1376 |
| 548135 | 2028 | 2043 | TCAGAATTTGACTTGA | eekd$_{10}$kke | 46 | 34127 | 34142 | 1377 |
| 548136 | 2031 | 2046 | GGCTCAGAATTTGACT | eekd$_{10}$kke | 39 | 34130 | 34145 | 1378 |
| 548137 | 2032 | 2047 | AGGCTCAGAATTTGAC | eekd$_{10}$kke | 62 | 34131 | 34146 | 1379 |
| 548138 | 2036 | 2051 | CCCCAGGCTCAGAATT | eekd$_{10}$kke | 52 | 34135 | 34150 | 1380 |
| 548139 | 2047 | 2062 | AGATGAGGACCCCCCA | eekd$_{10}$kke | 56 | 34146 | 34161 | 1381 |
| 548140 | 2048 | 2063 | CAGATGAGGACCCCCC | eekd$_{10}$kke | 74 | 34147 | 34162 | 1382 |
| 548141 | 2049 | 2064 | GCAGATGAGGACCCCC | eekd$_{10}$kke | 66 | 34148 | 34163 | 1383 |
| 548142 | 2063 | 2078 | ACTCTCCATGCTTTGC | eekd$_{10}$kke | 44 | 34162 | 34177 | 1384 |
| 548143 | 2064 | 2079 | CACTCTCCATGCTTTG | eekd$_{10}$kke | 39 | 34163 | 34178 | 1385 |
| 548144 | 2068 | 2083 | ATGCCACTCTCCATGC | eekd$_{10}$kke | 52 | 34167 | 34182 | 1386 |
| 548145 | 2079 | 2094 | ATGCAAAGAAGATGCC | eekd$_{10}$kke | 63 | 34178 | 34193 | 1387 |
| 548146 | 2088 | 2103 | GTCCTTAGGATGCAAA | eekd$_{10}$kke | 68 | 34187 | 34202 | 1388 |
| 548147 | 2089 | 2104 | CGTCCTTAGGATGCAA | eekd$_{10}$kke | 81 | 34188 | 34203 | 1389 |
| 548148 | 2114 | 2129 | GCAGCTCTGAGTGCAC | eekd$_{10}$kke | 66 | 34213 | 34228 | 1390 |
| 548149 | 2127 | 2142 | GACATTGTCCTCAGCA | eekd$_{10}$kke | 39 | 34226 | 34241 | 1391 |
| 548150 | 2129 | 2144 | CAGACATTGTCCTCAG | eekd$_{10}$kke | 60 | 34228 | 34243 | 1392 |

TABLE 141

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547747 | n/a | n/a | TCACTGTACTAGTTTC | eekd$_{10}$kke | 84 | 14746 | 14761 | 1267 |
| | | | | | | 14817 | 14832 | |
| | | | | | | 14888 | 14903 | |
| | | | | | | 14947 | 14962 | |
| | | | | | | 15007 | 15022 | |
| | | | | | | 15079 | 15094 | |
| | | | | | | 15222 | 15237 | |
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |

TABLE 141-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15817 | 15832 | |
| | | | | | | 15889 | 15904 | |
| | | | | | | 15947 | 15962 | |
| 547843 | 384 | 399 | CACTTATTTGATGACC | eekd$_{10}$kke | 83 | 9918 | 9933 | 1393 |
| 547844 | 385 | 400 | GCACTTATTTGATGAC | eekd$_{10}$kke | 13 | n/a | n/a | 1394 |
| 547845 | 394 | 409 | CGATGGCAAGCACTTA | eekd$_{10}$kke | 0 | n/a | n/a | 1395 |
| 547846 | 395 | 410 | TCGATGGCAAGCACTT | eekd$_{10}$kke | 0 | n/a | n/a | 1396 |
| 547847 | 396 | 411 | CTCGATGGCAAGCACT | eekd$_{10}$kke | 46 | n/a | n/a | 1397 |
| 547848 | 400 | 415 | ATGTCTCGATGGCAAG | eekd$_{10}$kke | 93 | 12656 | 12671 | 1398 |
| 547849 | 401 | 416 | AATGTCTCGATGGCAA | eekd$_{10}$kke | 79 | 12657 | 12672 | 1399 |
| 547850 | 402 | 417 | AAATGTCTCGATGGCA | eekd$_{10}$kke | 51 | 12658 | 12673 | 1400 |
| 547851 | 403 | 418 | TAAATGTCTCGATGGC | eekd$_{10}$kke | 93 | 12659 | 12674 | 1401 |
| 547852 | 404 | 419 | ATAAATGTCTCGATGG | eekd$_{10}$kke | 67 | 12660 | 12675 | 1402 |
| 547853 | 405 | 420 | TATAAATGTCTCGATG | eekd$_{10}$kke | 0 | 12661 | 12676 | 1403 |
| 547854 | 416 | 431 | ATCAACTCCTTTATAA | eekd$_{10}$kke | 10 | 12672 | 12687 | 1404 |
| 547855 | 417 | 432 | TATCAACTCCTTTATA | eekd$_{10}$kke | 59 | 12673 | 12688 | 1405 |
| 547856 | 419 | 434 | CATATCAACTCCTTTA | eekd$_{10}$kke | 93 | 12675 | 12690 | 1406 |
| 547858 | 423 | 438 | CTCTCATATCAACTCC | eekd$_{10}$kke | 82 | 12679 | 12694 | 1407 |
| 547859 | 424 | 439 | CCTCTCATATCAACTC | eekd$_{10}$kke | 77 | 12680 | 12695 | 1408 |
| 547860 | 425 | 440 | TCCTCTCATATCAACT | eekd$_{10}$kke | 71 | 12681 | 12696 | 1409 |
| 547861 | 427 | 442 | ACTCCTCTCATATCAA | eekd$_{10}$kke | 0 | 12683 | 12698 | 1410 |
| 547862 | 428 | 443 | GACTCCTCTCATATCA | eekd$_{10}$kke | 22 | 12684 | 12699 | 1411 |
| 547863 | 429 | 444 | TGACTCCTCTCATATC | eekd$_{10}$kke | 73 | 12685 | 12700 | 1412 |
| 547864 | 430 | 445 | TTGACTCCTCTCATAT | eekd$_{10}$kke | 53 | 12686 | 12701 | 1413 |
| 547865 | 434 | 449 | AAAATTGACTCCTCTC | eekd$_{10}$kke | 3 | 12690 | 12705 | 1414 |
| 547866 | 436 | 451 | TTAAAATTGACTCCTC | eekd$_{10}$kke | 46 | 12692 | 12707 | 1415 |
| 547867 | 447 | 462 | CCTTAGACACATTAAA | eekd$_{10}$kke | 34 | 12703 | 12718 | 1416 |
| 547868 | 448 | 463 | ACCTTAGACACATTAA | eekd$_{10}$kke | 47 | 12704 | 12719 | 1417 |
| 547869 | 449 | 464 | AACCTTAGACACATTA | eekd$_{10}$kke | 45 | 12705 | 12720 | 1418 |
| 547870 | 451 | 466 | CTAACCTTAGACACAT | eekd$_{10}$kke | 89 | 12707 | 12722 | 1419 |
| 547871 | 452 | 467 | GCTAACCTTAGACACA | eekd$_{10}$kke | 96 | 12708 | 12723 | 1420 |
| 547872 | 453 | 468 | TGCTAACCTTAGACAC | eekd$_{10}$kke | 85 | 12709 | 12724 | 1421 |
| 547873 | 454 | 469 | CTGCTAACCTTAGACA | eekd$_{10}$kke | 77 | 12710 | 12725 | 1422 |
| 547874 | 455 | 470 | ACTGCTAACCTTAGAC | eekd$_{10}$kke | 70 | 12711 | 12726 | 1423 |
| 547875 | 456 | 471 | CACTGCTAACCTTAGA | eekd$_{10}$kke | 73 | 12712 | 12727 | 1424 |
| 547876 | 457 | 472 | ACACTGCTAACCTTAG | eekd$_{10}$kke | 78 | 12713 | 12728 | 1425 |
| 547877 | 458 | 473 | AACACTGCTAACCTTA | eekd$_{10}$kke | 81 | 12714 | 12729 | 1426 |
| 547879 | 460 | 475 | TCAACACTGCTAACCT | eekd$_{10}$kke | 69 | 12716 | 12731 | 1427 |

TABLE 141-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547880 | 461 | 476 | TTCAACACTGCTAACC | eekd$_{10}$kke | 69 | 12717 | 12732 | 1428 |
| 547881 | 465 | 480 | ATTCTTCAACACTGCT | eekd$_{10}$kke | 0 | 12721 | 12736 | 1429 |
| 547882 | 500 | 515 | CTGGCAGCGAATGTTA | eekd$_{10}$kke | 91 | 12756 | 12771 | 1430 |
| 547883 | 501 | 516 | ACTGGCAGCGAATGTT | eekd$_{10}$kke | 99 | 12757 | 12772 | 1431 |
| 547884 | 518 | 533 | CGTGGCATATGAAAAA | eekd$_{10}$kke | 87 | 12774 | 12789 | 1432 |
| 547885 | 539 | 554 | CTCTGCCTTGTGAAAT | eekd$_{10}$kke | 45 | 12795 | 12810 | 1433 |
| 547886 | 544 | 559 | CGGTACTCTGCCTTGT | eekd$_{10}$kke | 97 | 12800 | 12815 | 1434 |
| 547889 | 547 | 562 | TTCCGGTACTCTGCCT | eekd$_{10}$kke | 91 | n/a | n/a | 1435 |
| 547890 | 550 | 565 | TTGTTCCGGTACTCTG | eekd$_{10}$kke | 97 | n/a | n/a | 1436 |
| 547891 | 551 | 566 | ATTGTTCCGGTACTCT | eekd$_{10}$kke | 84 | n/a | n/a | 1437 |
| 547892 | 553 | 568 | CAATTGTTCCGGTACT | eekd$_{10}$kke | 29 | n/a | n/a | 1438 |
| 547893 | 554 | 569 | GCAATTGTTCCGGTAC | eekd$_{10}$kke | 81 | n/a | n/a | 1439 |
| 547894 | 555 | 570 | GGCAATTGTTCCGGTA | eekd10kke | 92 | n/a | n/a | 1440 |
| 547898 | 563 | 578 | CTTTAATAGGCAATTG | eekd$_{10}$kke | 0 | 14134 | 14149 | 1441 |
| 547899 | 566 | 581 | GTACTTTAATAGGCAA | eekd$_{10}$kke | 49 | 14137 | 14152 | 1442 |
| 547900 | 567 | 582 | TGTACTTTAATAGGCA | eekd$_{10}$kke | 93 | 14138 | 14153 | 1443 |
| 547901 | 568 | 583 | CTGTACTTTAATAGGC | eekd$_{10}$kke | 77 | 14139 | 14154 | 1444 |
| 547902 | 569 | 584 | ACTGTACTTTAATAGG | eekd$_{10}$kke | 20 | 14140 | 14155 | 1445 |
| 547903 | 604 | 619 | CTCAGCACCTTTATAG | eekd$_{10}$kke | 62 | 14175 | 14190 | 1446 |
| 547904 | 605 | 620 | ACTCAGCACCTTTATA | eekd$_{10}$kke | 56 | 14176 | 14191 | 1447 |
| 547905 | 606 | 621 | TACTCAGCACCTTTAT | eekd$_{10}$kke | 20 | 14177 | 14192 | 1448 |
| 547906 | 607 | 622 | TTACTCAGCACCTTTA | eekd$_{10}$kke | 59 | 14178 | 14193 | 1449 |
| 547907 | 652 | 667 | ATTTCTGAAAGGGCAC | eekd$_{10}$kke | 27 | 14223 | 14238 | 1450 |
| 547908 | 654 | 669 | CAATTTCTGAAAGGGC | eekd$_{10}$kke | 94 | 14225 | 14240 | 1451 |
| 547909 | 655 | 670 | CCAATTTCTGAAAGGG | eekd$_{10}$kke | 82 | 14226 | 14241 | 1452 |
| 547910 | 656 | 671 | ACCAATTTCTGAAAGG | eekd$_{10}$kke | 26 | 14227 | 14242 | 1453 |
| 547911 | 661 | 676 | TGGCAACCAATTTCTG | eekd$_{10}$kke | 0 | n/a | n/a | 1454 |
| 547912 | 701 | 716 | ATCCACATCTGAGAAC | eekd$_{10}$kke | 23 | 26149 | 26164 | 1455 |
| 547913 | 706 | 721 | GCAACATCCACATCTG | eekd$_{10}$kke | 71 | 26154 | 26169 | 1456 |
| 547914 | 707 | 722 | GGCAACATCCACATCT | eekd$_{10}$kke | 74 | 26155 | 26170 | 1457 |
| 547915 | 708 | 723 | TGGCAACATCCACATC | eekd$_{10}$kke | 0 | 26156 | 26171 | 1458 |
| 547916 | 710 | 725 | CCTGGCAACATCCACA | eekd$_{10}$kke | 70 | 26158 | 26173 | 1459 |
| 547917 | 712 | 727 | ACCCTGGCAACATCCA | eekd$_{10}$kke | 33 | 26160 | 26175 | 1460 |
| 547918 | 713 | 728 | AACCCTGGCAACATCC | eekd$_{10}$kke | 1 | 26161 | 26176 | 1461 |
| 547919 | 714 | 729 | GAACCCTGGCAACATC | eekd$_{10}$kke | 41 | 26162 | 26177 | 1462 |

TABLE 142

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 62 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |
| 547747 | n/a | n/a | TCACTGTACTAGTTTC | eekd$_{10}$kke | 88 | 14746 | 14761 | 1267 |
|  |  |  |  |  |  | 14817 | 14832 |  |
|  |  |  |  |  |  | 14888 | 14903 |  |
|  |  |  |  |  |  | 14947 | 14962 |  |
|  |  |  |  |  |  | 15007 | 15022 |  |
|  |  |  |  |  |  | 15079 | 15094 |  |
|  |  |  |  |  |  | 15222 | 15237 |  |
|  |  |  |  |  |  | 15294 | 15309 |  |
|  |  |  |  |  |  | 15353 | 15368 |  |
|  |  |  |  |  |  | 15413 | 15428 |  |
|  |  |  |  |  |  | 15485 | 15500 |  |
|  |  |  |  |  |  | 15557 | 15572 |  |
|  |  |  |  |  |  | 15615 | 15630 |  |
|  |  |  |  |  |  | 15687 | 15702 |  |
|  |  |  |  |  |  | 15817 | 15832 |  |
|  |  |  |  |  |  | 15889 | 15904 |  |
|  |  |  |  |  |  | 15947 | 15962 |  |
| 547751 | 7 | 22 | TGAACGGTCTTCAAGC | eekd$_{10}$kke | 0 | 3399 | 3414 | 1463 |
| 547753 | 8 | 23 | ATGAACGGTCTTCAAG | eekd$_{10}$kke | 3 | 3400 | 3415 | 1464 |
| 547755 | 13 | 28 | TAAAAATGAACGGTCT | eekd$_{10}$kke | 0 | 3405 | 3420 | 1465 |
| 547757 | 28 | 43 | GAGTCTCTTGTCACTT | eekd$_{10}$kke | 69 | 3420 | 3435 | 1466 |
| 547759 | 29 | 44 | TGAGTCTCTTGTCACT | eekd$_{10}$kke | 73 | 3421 | 3436 | 1467 |
| 547763 | 31 | 46 | GGTGAGTCTCTTGTCA | eekd$_{10}$kke | 66 | 3423 | 3438 | 1468 |
| 547765 | 32 | 47 | AGGTGAGTCTCTTGTC | eekd$_{10}$kke | 20 | 3424 | 3439 | 1469 |
| 547767 | 35 | 50 | TGGAGGTGAGTCTCTT | eekd$_{10}$kke | 74 | 3427 | 3442 | 1470 |
| 547769 | 36 | 51 | TTGGAGGTGAGTCTCT | eekd$_{10}$kke | 81 | 3428 | 3443 | 1471 |
| 547771 | 37 | 52 | CTTGGAGGTGAGTCTC | eekd$_{10}$kke | 60 | 3429 | 3444 | 1472 |
| 547773 | 38 | 53 | TCTTGGAGGTGAGTCT | eekd$_{10}$kke | 47 | 3430 | 3445 | 1473 |
| 547777 | 43 | 58 | TTGCTTCTTGGAGGTG | eekd$_{10}$kke | 69 | 3435 | 3450 | 1474 |
| 547779 | 44 | 59 | ATTGCTTCTTGGAGGT | eekd$_{10}$kke | 41 | 3436 | 3451 | 1475 |
| 547781 | 46 | 61 | CAATTGCTTCTTGGAG | eekd$_{10}$kke | 49 | 3438 | 3453 | 1476 |
| 547783 | 48 | 63 | CACAATTGCTTCTTGG | eekd$_{10}$kke | 48 | 3440 | 3455 | 1477 |
| 547784 | 72 | 87 | GCTTGAATAAAATCAT | eekd$_{10}$kke | 46 | 4071 | 4086 | 1478 |
| 547785 | 79 | 94 | GTTGCTTGCTTGAATA | eekd$_{10}$kke | 48 | 4078 | 4093 | 1479 |
| 547786 | 80 | 95 | AGTTGCTTGCTTGAAT | eekd$_{10}$kke | 44 | 4079 | 4094 | 1480 |
| 547787 | 81 | 96 | AAGTTGCTTGCTTGAA | eekd$_{10}$kke | 22 | 4080 | 4095 | 1481 |

TABLE 142-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547788 | 82 | 97 | TAAGTTGCTTGCTTGA | eekd$_{10}$kke | 49 | 4081 | 4096 | 1482 |
| 547789 | 86 | 101 | GAAATAAGTTGCTTGC | eekd$_{10}$kke | 20 | 4085 | 4100 | 1483 |
| 547790 | 87 | 102 | TGAAATAAGTTGCTTG | eekd$_{10}$kke | 23 | 4086 | 4101 | 1484 |
| 547791 | 106 | 121 | ACTGTAGCAAACAAGG | eekd$_{10}$kke | 49 | 4105 | 4120 | 1485 |
| 547792 | 116 | 131 | TCCACAGGAAACTGTA | eekd$_{10}$kke | 31 | n/a | n/a | 1486 |
| 547793 | 117 | 132 | ATCCACAGGAAACTGT | eekd$_{10}$kke | 16 | n/a | n/a | 1487 |
| 547794 | 136 | 151 | TCATAGAGTTGAGTCA | eekd$_{10}$kke | 49 | 8008 | 8023 | 1488 |
| 547795 | 155 | 170 | ACCTCTGAAGAAGGCG | eekd$_{10}$kke | 66 | 8027 | 8042 | 1489 |
| 547796 | 161 | 176 | ATCCCCACCTCTGAAG | eekd$_{10}$kke | 35 | 8033 | 8048 | 1490 |
| 547797 | 167 | 182 | AGCTACATCCCCACCT | eekd$_{10}$kke | 33 | 8039 | 8054 | 1491 |
| 547799 | 169 | 184 | GAAGCTACATCCCCAC | eekd$_{10}$kke | 41 | 8041 | 8056 | 1492 |
| 547800 | 174 | 189 | ACATGGAAGCTACATC | eekd$_{10}$kke | 20 | 8046 | 8061 | 1493 |
| 547801 | 175 | 190 | TACATGGAAGCTACAT | eekd$_{10}$kke | 11 | 8047 | 8062 | 1494 |
| 547802 | 176 | 191 | GTACATGGAAGCTACA | eekd$_{10}$kke | 41 | 8048 | 8063 | 1495 |
| 547803 | 177 | 192 | TGTACATGGAAGCTAC | eekd$_{10}$kke | 0 | 8049 | 8064 | 1496 |
| 547804 | 178 | 193 | GTGTACATGGAAGCTA | eekd$_{10}$kke | 22 | 8050 | 8065 | 1497 |
| 547805 | 180 | 195 | GGGTGTACATGGAAGC | eekd$_{10}$kke | 54 | 8052 | 8067 | 1498 |
| 547807 | 197 | 212 | GCAGTATTGGGCATTT | eekd$_{10}$kke | 75 | 8069 | 8084 | 1499 |
| 547808 | 203 | 218 | CATCTGGCAGTATTGG | eekd$_{10}$kke | 56 | 8075 | 8090 | 1500 |
| 547809 | 204 | 219 | TCATCTGGCAGTATTG | eekd$_{10}$kke | 33 | 8076 | 8091 | 1501 |
| 547810 | 206 | 221 | CCTCATCTGGCAGTAT | eekd$_{10}$kke | 60 | 8078 | 8093 | 1502 |
| 547811 | 207 | 222 | ACCTCATCTGGCAGTA | eekd$_{10}$kke | 49 | 8079 | 8094 | 1503 |
| 547812 | 211 | 226 | GTGCACCTCATCTGGC | eekd$_{10}$kke | 51 | 8083 | 8098 | 1504 |
| 547813 | 219 | 234 | GGTGGAATGTGCACCT | eekd$_{10}$kke | 34 | 8091 | 8106 | 1505 |
| 547814 | 220 | 235 | GGGTGGAATGTGCACC | eekd$_{10}$kke | 60 | 8092 | 8107 | 1506 |
| 547815 | 255 | 270 | AACTTGCTGGAAGAAA | eekd$_{10}$kke | 3 | 8127 | 8142 | 1507 |
| 547816 | 256 | 271 | GAACTTGCTGGAAGAA | eekd$_{10}$kke | 45 | 8128 | 8143 | 1508 |
| 547817 | 257 | 272 | TGAACTTGCTGGAAGA | eekd$_{10}$kke | 18 | 8129 | 8144 | 1509 |
| 547818 | 260 | 275 | GATTGAACTTGCTGGA | eekd$_{10}$kke | 4 | 8132 | 8147 | 1510 |
| 547819 | 264 | 279 | CATTGATTGAACTTGC | eekd$_{10}$kke | 11 | 8136 | 8151 | 1511 |
| 547820 | 265 | 280 | TCATTGATTGAACTTG | eekd$_{10}$kke | 0 | 8137 | 8152 | 1512 |
| 547821 | 282 | 297 | CAAACCTTTTCTCCAT | eekd$_{10}$kke | 44 | n/a | n/a | 1513 |
| 547822 | 287 | 302 | GCAACCAAACCTTTTC | eekd$_{10}$kke | 71 | n/a | n/a | 1514 |
| 547823 | 288 | 303 | AGCAACCAAACCTTTT | eekd$_{10}$kke | 51 | n/a | n/a | 1515 |
| 547824 | 331 | 346 | CGATGTACTTTTGGCA | eekd$_{10}$kke | 82 | 9865 | 9880 | 1516 |
| 547825 | 332 | 347 | TCGATGTACTTTTGGC | eekd$_{10}$kke | 59 | 9866 | 9881 | 1517 |

TABLE 142-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547826 | 333 | 348 | TTCGATGTACTTTTGG | eekd$_{10}$kke | 31 | 9867 | 9882 | 1518 |
| 547827 | 334 | 349 | GTTCGATGTACTTTTG | eekd$_{10}$kke | 47 | 9868 | 9883 | 1519 |
| 547828 | 337 | 352 | CCTGTTCGATGTACTT | eekd$_{10}$kke | 63 | 9871 | 9886 | 1520 |
| 547829 | 338 | 353 | ACCTGTTCGATGTACT | eekd$_{10}$kke | 59 | 9872 | 9887 | 1521 |
| 547830 | 340 | 355 | GCACCTGTTCGATGTA | eekd$_{10}$kke | 74 | 9874 | 9889 | 1522 |
| 547831 | 342 | 357 | CTGCACCTGTTCGATG | eekd$_{10}$kke | 49 | 9876 | 9891 | 1523 |
| 547832 | 343 | 358 | ACTGCACCTGTTCGAT | eekd$_{10}$kke | 59 | 9877 | 9892 | 1524 |
| 547833 | 344 | 359 | AACTGCACCTGTTCGA | eekd$_{10}$kke | 40 | 9878 | 9893 | 1525 |
| 547834 | 345 | 360 | AAACTGCACCTGTTCG | eekd$_{10}$kke | 63 | 9879 | 9894 | 1526 |
| 547835 | 349 | 364 | CCAGAAACTGCACCTG | eekd$_{10}$kke | 81 | 9883 | 9898 | 1527 |
| 547836 | 350 | 365 | TCCAGAAACTGCACCT | eekd$_{10}$kke | 50 | 9884 | 9899 | 1528 |
| 547837 | 352 | 367 | TGTCCAGAAACTGCAC | eekd$_{10}$kke | 51 | 9886 | 9901 | 1529 |
| 547838 | 362 | 377 | CTTCAAGGAATGTCCA | eekd$_{10}$kke | 45 | 9896 | 9911 | 1530 |
| 547839 | 363 | 378 | GCTTCAAGGAATGTCC | eekd$_{10}$kke | 35 | 9897 | 9912 | 1531 |
| 547840 | 365 | 380 | TTGCTTCAAGGAATGT | eekd$_{10}$kke | 36 | 9899 | 9914 | 1532 |
| 547841 | 369 | 384 | CACATTGCTTCAAGGA | eekd$_{10}$kke | 42 | 9903 | 9918 | 1533 |
| 547842 | 375 | 390 | GATGACCACATTGCTT | eekd$_{10}$kke | 10 | 9909 | 9924 | 1534 |

TABLE 143

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 75 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547747 | n/a | n/a | TCACTGTACTAGTTTC | eekd$_{10}$kke | 91 | 14746 14817 14888 14947 15007 15079 15222 15294 15353 | 14761 14832 14903 14962 15022 15094 15237 15309 15368 | 1267 |

TABLE 143-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 547843 | 384 | 399 | CACTTATTTGATGACC | eekd$_{10}$kke | 83 | 9918 | 9933 | 1393 |
| 547844 | 385 | 400 | GCACTTATTTGATGAC | eekd$_{10}$kke | 76 | n/a | n/a | 1394 |
| 547845 | 394 | 409 | CGATGGCAAGCACTTA | eekd$_{10}$kke | 64 | n/a | n/a | 1395 |
| 547846 | 395 | 410 | TCGATGGCAAGCACTT | eekd$_{10}$kke | 42 | n/a | n/a | 1396 |
| 547847 | 396 | 411 | CTCGATGGCAAGCACT | eekd$_{10}$kke | 72 | n/a | n/a | 1397 |
| 547848 | 400 | 415 | ATGTCTCGATGGCAAG | eekd$_{10}$kke | 79 | 12656 | 12671 | 1398 |
| 547849 | 401 | 416 | AATGTCTCGATGGCAA | eekd$_{10}$kke | 90 | 12657 | 12672 | 1399 |
| 547850 | 402 | 417 | AAATGTCTCGATGGCA | eekd$_{10}$kke | 80 | 12658 | 12673 | 1400 |
| 547851 | 403 | 418 | TAAATGTCTCGATGGC | eekd$_{10}$kke | 84 | 12659 | 12674 | 1401 |
| 547852 | 404 | 419 | ATAAATGTCTCGATGG | eekd$_{10}$kke | 66 | 12660 | 12675 | 1402 |
| 547853 | 405 | 420 | TATAAATGTCTCGATG | eekd$_{10}$kke | 30 | 12661 | 12676 | 1403 |
| 547854 | 416 | 431 | ATCAACTCCTTTATAA | eekd$_{10}$kke | 9 | 12672 | 12687 | 1404 |
| 547855 | 417 | 432 | TATCAACTCCTTTATA | eekd$_{10}$kke | 38 | 12673 | 12688 | 1405 |
| 547856 | 419 | 434 | CATATCAACTCCTTTA | eekd$_{10}$kke | 51 | 12675 | 12690 | 1406 |
| 547857 | 421 | 436 | CTCATATCAACTCCTT | eekd$_{10}$kke | 84 | 12677 | 12692 | 1535 |
| 547858 | 423 | 438 | CTCTCATATCAACTCC | eekd$_{10}$kke | 76 | 12679 | 12694 | 1407 |
| 547859 | 424 | 439 | CCTCTCATATCAACTC | eekd$_{10}$kke | 88 | 12680 | 12695 | 1408 |
| 547860 | 425 | 440 | TCCTCTCATATCAACT | eekd$_{10}$kke | 70 | 12681 | 12696 | 1409 |
| 547861 | 427 | 442 | ACTCCTCTCATATCAA | eekd$_{10}$kke | 57 | 12683 | 12698 | 1410 |
| 547862 | 428 | 443 | GACTCCTCTCATATCA | eekd$_{10}$kke | 88 | 12684 | 12699 | 1411 |
| 547863 | 429 | 444 | TGACTCCTCTCATATC | eekd$_{10}$kke | 77 | 12685 | 12700 | 1412 |
| 547864 | 430 | 445 | TTGACTCCTCTCATAT | eekd$_{10}$kke | 73 | 12686 | 12701 | 1413 |
| 547865 | 434 | 449 | AAAATTGACTCCTCTC | eekd$_{10}$kke | 61 | 12690 | 12705 | 1414 |
| 547866 | 436 | 451 | TTAAAATTGACTCCTC | eekd$_{10}$kke | 40 | 12692 | 12707 | 1415 |
| 547867 | 447 | 462 | CCTTAGACACATTAAA | eekd$_{10}$kke | 53 | 12703 | 12718 | 1416 |
| 547868 | 448 | 463 | ACCTTAGACACATTAA | eekd$_{10}$kke | 71 | 12704 | 12719 | 1417 |
| 547869 | 449 | 464 | AACCTTAGACACATTA | eekd$_{10}$kke | 77 | 12705 | 12720 | 1418 |
| 547870 | 451 | 466 | CTAACCTTAGACACAT | eekd$_{10}$kke | 83 | 12707 | 12722 | 1419 |
| 547871 | 452 | 467 | GCTAACCTTAGACACA | eekd$_{10}$kke | 77 | 12708 | 12723 | 1420 |
| 547872 | 453 | 468 | TGCTAACCTTAGACAC | eekd$_{10}$kke | 73 | 12709 | 12724 | 1421 |
| 547873 | 454 | 469 | CTGCTAACCTTAGACA | eekd$_{10}$kke | 82 | 12710 | 12725 | 1422 |
| 547874 | 455 | 470 | ACTGCTAACCTTAGAC | eekd$_{10}$kke | 60 | 12711 | 12726 | 1423 |

TABLE 143-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547875 | 456 | 471 | CACTGCTAACCTTAGA | eekd$_{10}$kke | 57 | 12712 | 12727 | 1424 |
| 547876 | 457 | 472 | ACACTGCTAACCTTAG | eekd$_{10}$kke | 59 | 12713 | 12728 | 1425 |
| 547877 | 458 | 473 | AACACTGCTAACCTTA | eekd$_{10}$kke | 93 | 12714 | 12729 | 1426 |
| 547878 | 459 | 474 | CAACACTGCTAACCTT | eekd$_{10}$kke | 62 | 12715 | 12730 | 1536 |
| 547879 | 460 | 475 | TCAACACTGCTAACCT | eekd$_{10}$kke | 65 | 12716 | 12731 | 1427 |
| 547880 | 461 | 476 | TTCAACACTGCTAACC | eekd$_{10}$kke | 59 | 12717 | 12732 | 1428 |
| 547881 | 465 | 480 | ATTCTTCAACACTGCT | eekd$_{10}$kke | 50 | 12721 | 12736 | 1429 |
| 547882 | 500 | 515 | CTGGCAGCGAATGTTA | eekd$_{10}$kke | 96 | 12756 | 12771 | 1430 |
| 547883 | 501 | 516 | ACTGGCAGCGAATGTT | eekd$_{10}$kke | 0 | 12757 | 12772 | 1431 |
| 547884 | 518 | 533 | CGTGGCATATGAAAAA | eekd$_{10}$kke | 49 | 12774 | 12789 | 1432 |
| 547885 | 539 | 554 | CTCTGCCTTGTGAAAT | eekd$_{10}$kke | 57 | 12795 | 12810 | 1433 |
| 547886 | 544 | 559 | CGGTACTCTGCCTTGT | eekd$_{10}$kke | 89 | 12800 | 12815 | 1434 |
| 547887 | 545 | 560 | CCGGTACTCTGCCTTG | eekd$_{10}$kke | 99 | 12801 | 12816 | 1537 |
| 547888 | 546 | 561 | TCCGGTACTCTGCCTT | eekd$_{10}$kke | 99 | n/a | n/a | 1538 |
| 547889 | 547 | 562 | TTCCGGTACTCTGCCT | eekd$_{10}$kke | 97 | n/a | n/a | 1435 |
| 547890 | 550 | 565 | TTGTTCCGGTACTCTG | eekd$_{10}$kke | 90 | n/a | n/a | 1436 |
| 547891 | 551 | 566 | ATTGTTCCGGTACTCT | eekd$_{10}$kke | 88 | n/a | n/a | 1437 |
| 547892 | 553 | 568 | CAATTGTTCCGGTACT | eekd$_{10}$kke | 28 | n/a | n/a | 1438 |
| 547893 | 554 | 569 | GCAATTGTTCCGGTAC | eekd$_{10}$kke | 80 | n/a | n/a | 1439 |
| 547894 | 555 | 570 | GGCAATTGTTCCGGTA | eekd$_{10}$kke | 91 | n/a | n/a | 1440 |
| 547895 | 556 | 571 | AGGCAATTGTTCCGGT | eekd$_{10}$kke | 94 | n/a | n/a | 1539 |
| 547896 | 557 | 572 | TAGGCAATTGTTCCGG | eekd$_{10}$kke | 95 | n/a | n/a | 1540 |
| 547897 | 558 | 573 | ATAGGCAATTGTTCCG | eekd$_{10}$kke | 82 | n/a | n/a | 1541 |
| 547898 | 563 | 578 | CTTTAATAGGCAATTG | eekd$_{10}$kke | 28 | 14134 | 14149 | 1441 |
| 547899 | 566 | 581 | GTACTTTAATAGGCAA | eekd$_{10}$kke | 68 | 14137 | 14152 | 1442 |
| 547900 | 567 | 582 | TGTACTTTAATAGGCA | eekd$_{10}$kke | 68 | 14138 | 14153 | 1443 |
| 547901 | 568 | 583 | CTGTACTTTAATAGGC | eekd$_{10}$kke | 85 | 14139 | 14154 | 1444 |
| 547902 | 569 | 584 | ACTGTACTTTAATAGG | eekd$_{10}$kke | 33 | 14140 | 14155 | 1445 |
| 547903 | 604 | 619 | CTCAGCACCTTTATAG | eekd$_{10}$kke | 6 | 14175 | 14190 | 1446 |
| 547904 | 605 | 620 | ACTCAGCACCTTTATA | eekd$_{10}$kke | 41 | 14176 | 14191 | 1447 |
| 547905 | 606 | 621 | TACTCAGCACCTTTAT | eekd$_{10}$kke | 59 | 14177 | 14192 | 1448 |
| 547906 | 607 | 622 | TTACTCAGCACCTTTA | eekd$_{10}$kke | 70 | 14178 | 14193 | 1449 |
| 547907 | 652 | 667 | ATTTCTGAAAGGGCAC | eekd$_{10}$kke | 27 | 14223 | 14238 | 1450 |
| 547908 | 654 | 669 | CAATTTCTGAAAGGGC | eekd$_{10}$kke | 71 | 14225 | 14240 | 1451 |
| 547909 | 655 | 670 | CCAATTTCTGAAAGGG | eekd$_{10}$kke | 51 | 14226 | 14241 | 1452 |
| 547910 | 656 | 671 | ACCAATTTCTGAAAGG | eekd$_{10}$kke | 34 | 14227 | 14242 | 1453 |
| 547911 | 661 | 676 | TGGCAACCAATTTCTG | eekd$_{10}$kke | 15 | n/a | n/a | 1454 |

TABLE 143-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547912 | 701 | 716 | ATCCACATCTGAGAAC | eekd$_{10}$kke | 53 | 26149 | 26164 | 1455 |
| 547913 | 706 | 721 | GCAACATCCACATCTG | eekd$_{10}$kke | 61 | 26154 | 26169 | 1456 |
| 547914 | 707 | 722 | GGCAACATCCACATCT | eekd$_{10}$kke | 63 | 26155 | 26170 | 1457 |
| 547915 | 708 | 723 | TGGCAACATCCACATC | eekd$_{10}$kke | 62 | 26156 | 26171 | 1458 |
| 547916 | 710 | 725 | CCTGGCAACATCCACA | eekd$_{10}$kke | 56 | 26158 | 26173 | 1459 |
| 547917 | 712 | 727 | ACCCTGGCAACATCCA | eekd$_{10}$kke | 54 | 26160 | 26175 | 1460 |
| 547918 | 713 | 728 | AACCCTGGCAACATCC | eekd$_{10}$kke | 65 | 26161 | 26176 | 1461 |
| 547919 | 714 | 729 | GAACCCTGGCAACATC | eekd$_{10}$kke | 73 | 26162 | 26177 | 1462 |

TABLE 144

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 16 | 14744<br>14815<br>14886<br>14945<br>15005<br>15077<br>15220<br>15292<br>15351<br>15411<br>15483<br>15555<br>15613<br>15685<br>15815<br>15887<br>15945 | 14763<br>14834<br>14905<br>14964<br>15024<br>15096<br>15239<br>15311<br>15370<br>15430<br>15502<br>15574<br>15632<br>15704<br>15834<br>15906<br>15964 | 334 |
| 547747 | n/a | n/a | TCACTGTACTAGTTTC | eekd$_{10}$kke | 83 | 14746<br>14817<br>14888<br>14947<br>15007<br>15079<br>15222<br>15294<br>15353<br>15413<br>15485<br>15557<br>15615<br>15687<br>15817<br>15889<br>15947 | 14761<br>14832<br>14903<br>14962<br>15022<br>15094<br>15237<br>15309<br>15368<br>15428<br>15500<br>15572<br>15630<br>15702<br>15832<br>15904<br>15962 | 1267 |
| 547920 | 716 | 731 | GAGAACCCTGGCAACA | eekd$_{10}$kke | 52 | 26164 | 26179 | 1542 |
| 547921 | 717 | 732 | TGAGAACCCTGGCAAC | eekd$_{10}$kke | 43 | 26165 | 26180 | 1543 |
| 547922 | 722 | 737 | TGGAGTGAGAACCCTG | eekd$_{10}$kke | 79 | 26170 | 26185 | 1544 |
| 547923 | 725 | 740 | ATCTGGAGTGAGAACC | eekd$_{10}$kke | 68 | 26173 | 26188 | 1545 |

TABLE 144-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547924 | 742 | 757 | GTCCGACACACAAAAG | eekd$_{10}$kke | 53 | 26190 | 26205 | 1546 |
| 547925 | 743 | 758 | GGTCCGACACACAAAA | eekd$_{10}$kke | 16 | 26191 | 26206 | 1547 |
| 547927 | 745 | 760 | ATGGTCCGACACACAA | eekd$_{10}$kke | 79 | 26193 | 26208 | 1548 |
| 547928 | 746 | 761 | GATGGTCCGACACACA | eekd$_{10}$kke | 70 | 26194 | 26209 | 1549 |
| 547929 | 747 | 762 | AGATGGTCCGACACAC | eekd$_{10}$kke | 65 | 26195 | 26210 | 1550 |
| 547930 | 757 | 772 | TGATAGGTGCAGATGG | eekd$_{10}$kke | 48 | 26205 | 26220 | 1551 |
| 547931 | 758 | 773 | GTGATAGGTGCAGATG | eekd$_{10}$kke | 58 | 26206 | 26221 | 1552 |
| 547932 | 804 | 819 | CGATTTTCCATACATT | eekd$_{10}$kke | 33 | 26252 | 26267 | 1553 |
| 547933 | 805 | 820 | TCGATTTTCCATACAT | eekd$_{10}$kke | 44 | 26253 | 26268 | 1554 |
| 547934 | 806 | 821 | CTCGATTTTCCATACA | eekd$_{10}$kke | 38 | 26254 | 26269 | 1555 |
| 547935 | 807 | 822 | ACTCGATTTTCCATAC | eekd$_{10}$kke | 27 | 26255 | 26270 | 1556 |
| 547936 | 808 | 823 | GACTCGATTTTCCATA | eekd$_{10}$kke | 44 | 26256 | 26271 | 1557 |
| 547937 | 811 | 826 | TGTGACTCGATTTTCC | eekd$_{10}$kke | 56 | 26259 | 26274 | 1558 |
| 547938 | 812 | 827 | TTGTGACTCGATTTTC | eekd$_{10}$kke | 56 | 26260 | 26275 | 1559 |
| 547939 | 813 | 828 | TTTGTGACTCGATTTT | eekd$_{10}$kke | 70 | 26261 | 26276 | 1560 |
| 547940 | 817 | 832 | TTTCTTTGTGACTCGA | eekd$_{10}$kke | 71 | n/a | n/a | 1561 |
| 547941 | 852 | 867 | GTGTGCCACTTTCAGA | eekd$_{10}$kke | 66 | 27116 | 27131 | 1562 |
| 547942 | 853 | 868 | GGTGTGCCACTTTCAG | eekd$_{10}$kke | 85 | 27117 | 27132 | 1563 |
| 547943 | 854 | 869 | TGGTGTGCCACTTTCA | eekd$_{10}$kke | 83 | 27118 | 27133 | 1564 |
| 547944 | 857 | 872 | ACTTGGTGTGCCACTT | eekd$_{10}$kke | 54 | 27121 | 27136 | 1565 |
| 547945 | 858 | 873 | AACTTGGTGTGCCACT | eekd$_{10}$kke | 62 | 27122 | 27137 | 1566 |
| 547946 | 859 | 874 | GAACTTGGTGTGCCAC | eekd$_{10}$kke | 81 | 27123 | 27138 | 1567 |
| 547947 | 860 | 875 | GGAACTTGGTGTGCCA | eekd$_{10}$kke | 80 | 27124 | 27139 | 1568 |
| 547948 | 861 | 876 | AGGAACTTGGTGTGCC | eekd$_{10}$kke | 77 | 27125 | 27140 | 1569 |
| 547949 | 880 | 895 | GTGTTTTCTTGAGGAG | eekd$_{10}$kke | 6 | 27144 | 27159 | 1570 |
| 547950 | 881 | 896 | GGTGTTTTCTTGAGGA | eekd$_{10}$kke | 49 | 27145 | 27160 | 1571 |
| 547951 | 887 | 902 | AGATATGGTGTTTTCT | eekd$_{10}$kke | 25 | 27151 | 27166 | 1572 |
| 547952 | 888 | 903 | CAGATATGGTGTTTTC | eekd$_{10}$kke | 46 | 27152 | 27167 | 1573 |
| 547953 | 895 | 910 | CTATATCCAGATATGG | eekd$_{10}$kke | 16 | 27159 | 27174 | 1574 |
| 547954 | 902 | 917 | TAAAAGGCTATATCCA | eekd$_{10}$kke | 36 | 27166 | 27181 | 1575 |
| 547956 | 904 | 919 | GTTAAAAGGCTATATC | eekd$_{10}$kke | 13 | 27168 | 27183 | 1576 |
| 547957 | 905 | 920 | GGTTAAAAGGCTATAT | eekd$_{10}$kke | 6 | 27169 | 27184 | 1577 |
| 547958 | 907 | 922 | CAGGTTAAAAGGCTAT | eekd$_{10}$kke | 57 | 27171 | 27186 | 1578 |
| 547959 | 908 | 923 | GCAGGTTAAAAGGCTA | eekd$_{10}$kke | 60 | 27172 | 27187 | 1579 |
| 547960 | 909 | 924 | TGCAGGTTAAAAGGCT | eekd$_{10}$kke | 40 | 27173 | 27188 | 1580 |
| 547961 | 910 | 925 | TTGCAGGTTAAAAGGC | eekd$_{10}$kke | 5 | 27174 | 27189 | 1581 |
| 547962 | 911 | 926 | TTTGCAGGTTAAAAGG | eekd$_{10}$kke | 16 | 27175 | 27190 | 1582 |

TABLE 144-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547963 | 927 | 942 | GTTCAGGTAAAGTTCT | eekd$_{10}$kke | 22 | n/a | n/a | 1583 |
| 547964 | 928 | 943 | GGTTCAGGTAAAGTTC | eekd$_{10}$kke | 0 | n/a | n/a | 1584 |
| 547965 | 929 | 944 | GGGTTCAGGTAAAGTT | eekd$_{10}$kke | 29 | n/a | n/a | 1585 |
| 547966 | 930 | 945 | AGGGTTCAGGTAAAGT | eekd$_{10}$kke | 13 | n/a | n/a | 1586 |
| 547967 | 933 | 948 | GGCAGGGTTCAGGTAA | eekd$_{10}$kke | 25 | n/a | n/a | 1587 |
| 547968 | 940 | 955 | TTAGAATGGCAGGGTT | eekd$_{10}$kke | 37 | 27362 | 27377 | 1588 |
| 547969 | 953 | 968 | TCCCGGGTAAATTTTA | eekd$_{10}$kke | 0 | 27375 | 27390 | 1589 |
| 547970 | 954 | 969 | CTCCCGGGTAAATTTT | eekd$_{10}$kke | 42 | 27376 | 27391 | 1590 |
| 547972 | 958 | 973 | TCAACTCCCGGGTAAA | eekd$_{10}$kke | 49 | 27380 | 27395 | 1591 |
| 547973 | 961 | 976 | AAGTCAACTCCCGGGT | eekd$_{10}$kke | 62 | 27383 | 27398 | 1592 |
| 547974 | 962 | 977 | AAAGTCAACTCCCGGG | eekd$_{10}$kke | 52 | 27384 | 27399 | 1593 |
| 547975 | 963 | 978 | CAAAGTCAACTCCCGG | eekd$_{10}$kke | 44 | 27385 | 27400 | 1594 |
| 547976 | 964 | 979 | CCAAAGTCAACTCCCG | eekd$_{10}$kke | 49 | 27386 | 27401 | 1595 |
| 547977 | 967 | 982 | CCTCCAAAGTCAACTC | eekd$_{10}$kke | 57 | 27389 | 27404 | 1596 |
| 547978 | 1014 | 1029 | CTTGGCAAACATTCAC | eekd$_{10}$kke | 71 | 27436 | 27451 | 1597 |
| 547979 | 1018 | 1033 | GTCTCTTGGCAAACAT | eekd$_{10}$kke | 77 | 27440 | 27455 | 1598 |
| 547980 | 1020 | 1035 | AAGTCTCTTGGCAAAC | eekd$_{10}$kke | 54 | 27442 | 27457 | 1599 |
| 547981 | 1029 | 1044 | TCTTTGTGCAAGTCTC | eekd$_{10}$kke | 76 | 27451 | 27466 | 1600 |
| 547982 | 1034 | 1049 | AATCATCTTTGTGCAA | eekd$_{10}$kke | 54 | 27456 | 27471 | 1601 |
| 547983 | 1035 | 1050 | GAATCATCTTTGTGCA | eekd$_{10}$kke | 56 | 27457 | 27472 | 1602 |
| 547984 | 1036 | 1051 | CGAATCATCTTTGTGC | eekd$_{10}$kke | 55 | 27458 | 27473 | 1603 |
| 547985 | 1037 | 1052 | GCGAATCATCTTTGTG | eekd$_{10}$kke | 63 | 27459 | 27474 | 1604 |
| 547986 | 1039 | 1054 | CAGCGAATCATCTTTG | eekd$_{10}$kke | 63 | 27461 | 27476 | 1605 |
| 547987 | 1040 | 1055 | ACAGCGAATCATCTTT | eekd$_{10}$kke | 64 | 27462 | 27477 | 1606 |
| 547988 | 1042 | 1057 | TGACAGCGAATCATCT | eekd$_{10}$kke | 56 | 27464 | 27479 | 1607 |
| 547989 | 1043 | 1058 | CTGACAGCGAATCATC | eekd$_{10}$kke | 66 | 27465 | 27480 | 1608 |
| 547990 | 1044 | 1059 | ACTGACAGCGAATCAT | eekd$_{10}$kke | 58 | 27466 | 27481 | 1609 |
| 547991 | 1077 | 1092 | TACAGTCTTCTGGGAG | eekd$_{10}$kke | 0 | 27499 | 27514 | 1610 |
| 547992 | 1080 | 1095 | CCTTACAGTCTTCTGG | eekd$_{10}$kke | 17 | 27502 | 27517 | 1611 |
| 547993 | 1113 | 1128 | TAGATAATCTTAAGAA | eekd$_{10}$kke | 26 | 27634 | 27649 | 1612 |
| 547994 | 1120 | 1135 | CCATCCATAGATAATC | eekd$_{10}$kke | 53 | 27641 | 27656 | 1613 |
| 547995 | 1149 | 1164 | GTGTCCCATACGCAAT | eekd$_{10}$kke | 64 | 27670 | 27685 | 1614 |
| 547996 | 1150 | 1165 | TGTGTCCCATACGCAA | eekd$_{10}$kke | 65 | 27671 | 27686 | 1615 |

TABLE 145

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 0 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547747 | n/a | n/a | TCACTGTACTAGTTTC | eekd$_{10}$kke | 80 | 14746 14817 14888 14947 15007 15079 15222 15294 15353 15413 15485 15557 15615 15687 15817 15889 15947 | 14761 14832 14903 14962 15022 15094 15237 15309 15368 15428 15500 15572 15630 15702 15832 15904 15962 | 1267 |
| 547997 | 1151 | 1166 | TTGTGTCCCATACGCA | eekd$_{10}$kke | 89 | 27672 | 27687 | 1616 |
| 547998 | 1152 | 1167 | CTTGTGTCCCATACGC | eekd$_{10}$kke | 82 | 27673 | 27688 | 1617 |
| 547999 | 1153 | 1168 | CCTTGTGTCCCATACG | eekd$_{10}$kke | 50 | 27674 | 27689 | 1618 |
| 548000 | 1154 | 1169 | CCCTTGTGTCCCATAC | eekd$_{10}$kke | 54 | 27675 | 27690 | 1619 |
| 548001 | 1163 | 1178 | ACCAGAGCTCCCTTGT | eekd$_{10}$kke | 64 | 27684 | 27699 | 1620 |
| 548002 | 1164 | 1179 | AACCAGAGCTCCCTTG | eekd$_{10}$kke | 56 | 27685 | 27700 | 1621 |
| 548003 | 1165 | 1180 | TAACCAGAGCTCCCTT | eekd$_{10}$kke | 66 | 27686 | 27701 | 1622 |
| 548004 | 1167 | 1182 | AGTAACCAGAGCTCCC | eekd$_{10}$kke | 80 | 27688 | 27703 | 1623 |
| 548005 | 1169 | 1184 | AGAGTAACCAGAGCTC | eekd$_{10}$kke | 77 | 27690 | 27705 | 1624 |
| 548006 | 1172 | 1187 | CAAAGAGTAACCAGAG | eekd$_{10}$kke | 54 | 27693 | 27708 | 1625 |
| 548007 | 1174 | 1189 | CTCAAAGAGTAACCAG | eekd$_{10}$kke | 70 | 27695 | 27710 | 1626 |
| 548008 | 1175 | 1190 | TCTCAAAGAGTAACCA | eekd$_{10}$kke | 71 | 27696 | 27711 | 1627 |
| 548009 | 1184 | 1199 | GTTACACAATCTCAAA | eekd$_{10}$kke | 47 | 27705 | 27720 | 1628 |
| 548010 | 1187 | 1202 | AGTGTTACACAATCTC | eekd$_{10}$kke | 80 | 27708 | 27723 | 1629 |
| 548011 | 1189 | 1204 | CCAGTGTTACACAATC | eekd$_{10}$kke | 14 | 27710 | 27725 | 1630 |
| 548012 | 1192 | 1207 | TCCCCAGTGTTACACA | eekd$_{10}$kke | 3 | 27713 | 27728 | 1631 |
| 548013 | 1193 | 1208 | GTCCCCAGTGTTACAC | eekd$_{10}$kke | 37 | 27714 | 27729 | 1632 |
| 548014 | 1194 | 1209 | TGTCCCCAGTGTTACA | eekd$_{10}$kke | 31 | 27715 | 27730 | 1633 |
| 548015 | 1195 | 1210 | TTGTCCCCAGTGTTAC | eekd$_{10}$kke | 50 | 27716 | 27731 | 1634 |

TABLE 145-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548016 | 1248 | 1263 | AAGAGTTTGTTCCTCC | eekd$_{10}$kke | 55 | 27924 | 27939 | 1635 |
| 548017 | 1252 | 1267 | CAAGAAGAGTTTGTTC | eekd$_{10}$kke | 3 | 27928 | 27943 | 1636 |
| 548018 | 1253 | 1268 | CCAAGAAGAGTTTGTT | eekd$_{10}$kke | 22 | 27929 | 27944 | 1637 |
| 548019 | 1255 | 1270 | CCCCAAGAAGAGTTTG | eekd$_{10}$kke | 24 | 27931 | 27946 | 1638 |
| 548020 | 1256 | 1271 | TCCCCAAGAAGAGTTT | eekd$_{10}$kke | 76 | 27932 | 27947 | 1639 |
| 548021 | 1261 | 1276 | CACTCTCCCCAAGAAG | eekd$_{10}$kke | 0 | 27937 | 27952 | 1640 |
| 548022 | 1262 | 1277 | CCACTCTCCCCAAGAA | eekd$_{10}$kke | 69 | 27938 | 27953 | 1641 |
| 548023 | 1290 | 1305 | GCTTCACCTGCAGGCT | eekd$_{10}$kke | 58 | 27966 | 27981 | 1642 |
| 548024 | 1297 | 1312 | GCTGTCAGCTTCACCT | eekd$_{10}$kke | 79 | 27973 | 27988 | 1643 |
| 548025 | 1300 | 1315 | TGAGCTGTCAGCTTCA | eekd$_{10}$kke | 66 | 27976 | 27991 | 1644 |
| 548026 | 1332 | 1347 | GTCCTATGAGTGACCC | eekd$_{10}$kke | 52 | 28008 | 28023 | 1645 |
| 548027 | 1334 | 1349 | GTGTCCTATGAGTGAC | eekd$_{10}$kke | 18 | 28010 | 28025 | 1646 |
| 548028 | 1335 | 1350 | GGTGTCCTATGAGTGA | eekd$_{10}$kke | 38 | 28011 | 28026 | 1647 |
| 548029 | 1336 | 1351 | TGGTGTCCTATGAGTG | eekd$_{10}$kke | 12 | 28012 | 28027 | 1648 |
| 548030 | 1337 | 1352 | CTGGTGTCCTATGAGT | eekd$_{10}$kke | 52 | 28013 | 28028 | 1649 |
| 548031 | 1397 | 1412 | GATGCGCCAAACATCC | eekd$_{10}$kke | 73 | 30475 | 30490 | 1650 |
| 548032 | 1398 | 1413 | AGATGCGCCAAACATC | eekd$_{10}$kke | 51 | 30476 | 30491 | 1651 |
| 548034 | 1400 | 1415 | ATAGATGCGCCAAACA | eekd$_{10}$kke | 31 | 30478 | 30493 | 1652 |
| 548035 | 1404 | 1419 | CACTATAGATGCGCCA | eekd$_{10}$kke | 44 | 30482 | 30497 | 1653 |
| 548036 | 1405 | 1420 | CCACTATAGATGCGCC | eekd$_{10}$kke | 74 | 30483 | 30498 | 1654 |
| 548037 | 1427 | 1442 | AATGTCTGACAGATTT | eekd$_{10}$kke | 70 | 30505 | 30520 | 1655 |
| 548038 | 1428 | 1443 | TAATGTCTGACAGATT | eekd$_{10}$kke | 67 | 30506 | 30521 | 1656 |
| 548039 | 1445 | 1460 | GAAAGGTGTATCTTTT | eekd$_{10}$kke | 29 | 30523 | 30538 | 1657 |
| 548040 | 1449 | 1464 | GTGAGAAAGGTGTATC | eekd$_{10}$kke | 62 | 30527 | 30542 | 1658 |
| 548041 | 1450 | 1465 | TGTGAGAAAGGTGTAT | eekd$_{10}$kke | 64 | 30528 | 30543 | 1659 |
| 548042 | 1452 | 1467 | TTTGTGAGAAAGGTGT | eekd$_{10}$kke | 63 | 30530 | 30545 | 1660 |
| 548043 | 1453 | 1468 | ATTTGTGAGAAAGGTG | eekd$_{10}$kke | 76 | 30531 | 30546 | 1661 |
| 548044 | 1474 | 1489 | TGGTGAATAATAATCT | eekd$_{10}$kke | 12 | 30552 | 30567 | 1662 |
| 548045 | 1483 | 1498 | TTATAGTTTTGGTGAA | eekd$_{10}$kke | 0 | 30561 | 30576 | 1663 |
| 548046 | 1506 | 1521 | TATCATGATTCCCTTC | eekd$_{10}$kke | 84 | 30584 | 30599 | 1664 |
| 548047 | 1508 | 1523 | GATATCATGATTCCCT | eekd$_{10}$kke | 83 | 30586 | 30601 | 1665 |
| 548048 | 1509 | 1524 | CGATATCATGATTCCC | eekd$_{10}$kke | 84 | 30587 | 30602 | 1666 |
| 548049 | 1510 | 1525 | GCGATATCATGATTCC | eekd$_{10}$kke | 62 | 30588 | 30603 | 1667 |
| 548050 | 1512 | 1527 | AGGCGATATCATGATT | eekd$_{10}$kke | 37 | 30590 | 30605 | 1668 |
| 548051 | 1513 | 1528 | AAGGCGATATCATGAT | eekd$_{10}$kke | 61 | 30591 | 30606 | 1669 |
| 548052 | 1535 | 1550 | CAAAGGAGCCTGGAGT | eekd$_{10}$kke | 43 | 30613 | 30628 | 1670 |

TABLE 145-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548053 | 1538 | 1553 | ATTCAAAGGAGCCTGG | eekd$_{10}$kke | 36 | 30616 | 30631 | 1671 |
| 548054 | 1539 | 1554 | AATTCAAAGGAGCCTG | eekd$_{10}$kke | 45 | 30617 | 30632 | 1672 |
| 548055 | 1541 | 1556 | GTAATTCAAAGGAGCC | eekd$_{10}$kke | 78 | 30619 | 30634 | 1673 |
| 548056 | 1543 | 1558 | GTGTAATTCAAAGGAG | eekd$_{10}$kke | 40 | 30621 | 30636 | 1674 |
| 548057 | 1564 | 1579 | CATATTGGTTTTTGGA | eekd$_{10}$kke | 49 | 31870 | 31885 | 1675 |
| 548058 | 1565 | 1580 | GCATATTGGTTTTTGG | eekd$_{10}$kke | 71 | 31871 | 31886 | 1676 |
| 548059 | 1568 | 1583 | TAGGCATATTGGTTTT | eekd$_{10}$kke | 50 | 31874 | 31889 | 1677 |
| 548060 | 1588 | 1603 | CTTGTGTCACCTTTGG | eekd$_{10}$kke | 76 | 31894 | 31909 | 1678 |
| 548061 | 1589 | 1604 | GCTTGTGTCACCTTTG | eekd$_{10}$kke | 86 | 31895 | 31910 | 1679 |
| 548062 | 1598 | 1613 | ATAAATTGTGCTTGTG | eekd$_{10}$kke | 19 | 31904 | 31919 | 1680 |
| 548063 | 1600 | 1615 | GTATAAATTGTGCTTG | eekd$_{10}$kke | 35 | 31906 | 31921 | 1681 |
| 548064 | 1602 | 1617 | TGGTATAAATTGTGCT | eekd$_{10}$kke | 54 | 31908 | 31923 | 1682 |
| 548065 | 1603 | 1618 | TTGGTATAAATTGTGC | eekd$_{10}$kke | 22 | 31909 | 31924 | 1683 |
| 548067 | 1606 | 1621 | CAGTTGGTATAAATTG | eekd$_{10}$kke | 18 | 31912 | 31927 | 1684 |
| 548068 | 1609 | 1624 | CAACAGTTGGTATAAA | eekd$_{10}$kke | 0 | 31915 | 31930 | 1685 |
| 548069 | 1610 | 1625 | CCAACAGTTGGTATAA | eekd$_{10}$kke | 57 | 31916 | 31931 | 1686 |
| 548070 | 1611 | 1626 | CCCAACAGTTGGTATA | eekd$_{10}$kke | 85 | 31917 | 31932 | 1687 |
| 548071 | 1629 | 1644 | AGAAGCCCCATCCGGT | eekd$_{10}$kke | 55 | 31935 | 31950 | 1688 |
| 548072 | 1640 | 1655 | TTTCTCCTTCGAGAAG | eekd$_{10}$kke | 33 | 31946 | 31961 | 1689 |
| 548073 | 1641 | 1656 | CTTTCTCCTTCGAGAA | eekd$_{10}$kke | 24 | 31947 | 31962 | 1690 |

TABLE 146

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 19 | 14744 | 14763 | 334 |
|  |  |  |  |  |  | 14815 | 14834 |  |
|  |  |  |  |  |  | 14886 | 14905 |  |
|  |  |  |  |  |  | 14945 | 14964 |  |
|  |  |  |  |  |  | 15005 | 15024 |  |
|  |  |  |  |  |  | 15077 | 15096 |  |
|  |  |  |  |  |  | 15220 | 15239 |  |
|  |  |  |  |  |  | 15292 | 15311 |  |
|  |  |  |  |  |  | 15351 | 15370 |  |
|  |  |  |  |  |  | 15411 | 15430 |  |
|  |  |  |  |  |  | 15483 | 15502 |  |
|  |  |  |  |  |  | 15555 | 15574 |  |
|  |  |  |  |  |  | 15613 | 15632 |  |
|  |  |  |  |  |  | 15685 | 15704 |  |
|  |  |  |  |  |  | 15815 | 15834 |  |
|  |  |  |  |  |  | 15887 | 15906 |  |
|  |  |  |  |  |  | 15945 | 15964 |  |
| 547747 | n/a | n/a | TCACTGTACTAGTTTC | eekd$_{10}$kke | 66 | 14746 | 14761 | 1267 |
|  |  |  |  |  |  | 14817 | 14832 |  |
|  |  |  |  |  |  | 14888 | 14903 |  |

TABLE 146-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 14947 | 14962 | |
| | | | | | | 15007 | 15022 | |
| | | | | | | 15079 | 15094 | |
| | | | | | | 15222 | 15237 | |
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 548151 | 2139 | 2154 | GGGCTTCAGCCAGACA | eekd$_{10}$kke | 35 | 34238 | 34253 | 1691 |
| 548152 | 2140 | 2155 | CGGGCTTCAGCCAGAC | eekd$_{10}$kke | 32 | 34239 | 34254 | 1692 |
| 548153 | 2149 | 2164 | TGCTGAAAGCGGGCTT | eekd$_{10}$kke | 44 | 34248 | 34263 | 1693 |
| 548154 | 2150 | 2165 | GTGCTGAAAGCGGGCT | eekd$_{10}$kke | 7 | 34249 | 34264 | 1694 |
| 548155 | 2151 | 2166 | CGTGCTGAAAGCGGGC | eekd$_{10}$kke | 76 | 34250 | 34265 | 1695 |
| 548156 | 2168 | 2183 | TCAGCCCCTGGTTACG | eekd$_{10}$kke | 0 | 34267 | 34282 | 1696 |
| 548157 | 2172 | 2187 | ATTGTCAGCCCCTGGT | eekd$_{10}$kke | 7 | 34271 | 34286 | 1697 |
| 548158 | 2174 | 2189 | GCATTGTCAGCCCCTG | eekd$_{10}$kke | 18 | 34273 | 34288 | 1698 |
| 548159 | 2175 | 2190 | CGCATTGTCAGCCCCT | eekd$_{10}$kke | 59 | 34274 | 34289 | 1699 |
| 548160 | 2176 | 2191 | TCGCATTGTCAGCCCC | eekd$_{10}$kke | 60 | 34275 | 34290 | 1700 |
| 548161 | 2177 | 2192 | CTCGCATTGTCAGCCC | eekd$_{10}$kke | 59 | 34276 | 34291 | 1701 |
| 548162 | 2178 | 2193 | CCTCGCATTGTCAGCC | eekd$_{10}$kke | 25 | 34277 | 34292 | 1702 |
| 548163 | 2179 | 2194 | ACCTCGCATTGTCAGC | eekd$_{10}$kke | 46 | 34278 | 34293 | 1703 |
| 548164 | 2180 | 2195 | GACCTCGCATTGTCAG | eekd$_{10}$kke | 40 | 34279 | 34294 | 1704 |
| 548165 | 2181 | 2196 | CGACCTCGCATTGTCA | eekd$_{10}$kke | 53 | 34280 | 34295 | 1705 |
| 548166 | 2182 | 2197 | GCGACCTCGCATTGTC | eekd$_{10}$kke | 0 | 34281 | 34296 | 1706 |
| 548167 | 2183 | 2198 | TGCGACCTCGCATTGT | eekd$_{10}$kke | 36 | 34282 | 34297 | 1707 |
| 548168 | 2184 | 2199 | TTGCGACCTCGCATTG | eekd$_{10}$kke | 61 | 34283 | 34298 | 1708 |
| 548169 | 2185 | 2200 | GTTGCGACCTCGCATT | eekd$_{10}$kke | 7 | 34284 | 34299 | 1709 |
| 548170 | 2186 | 2201 | AGTTGCGACCTCGCAT | eekd$_{10}$kke | 68 | 34285 | 34300 | 1710 |
| 548171 | 2187 | 2202 | CAGTTGCGACCTCGCA | eekd$_{10}$kke | 47 | 34286 | 34301 | 1711 |
| 548172 | 2188 | 2203 | TCAGTTGCGACCTCGC | eekd$_{10}$kke | 0 | 34287 | 34302 | 1712 |
| 548173 | 2189 | 2204 | CTCAGTTGCGACCTCG | eekd$_{10}$kke | 51 | 34288 | 34303 | 1713 |
| 548174 | 2190 | 2205 | TCTCAGTTGCGACCTC | eekd$_{10}$kke | 68 | 34289 | 34304 | 1714 |
| 548175 | 2191 | 2206 | ATCTCAGTTGCGACCT | eekd$_{10}$kke | 0 | 34290 | 34305 | 1715 |
| 548176 | 2192 | 2207 | GATCTCAGTTGCGACC | eekd$_{10}$kke | 38 | 34291 | 34306 | 1716 |
| 548177 | 2193 | 2208 | AGATCTCAGTTGCGAC | eekd$_{10}$kke | 45 | 34292 | 34307 | 1717 |
| 548178 | 2194 | 2209 | GAGATCTCAGTTGCGA | eekd$_{10}$kke | 54 | 34293 | 34308 | 1718 |
| 548179 | 2195 | 2210 | GGAGATCTCAGTTGCG | eekd$_{10}$kke | 52 | 34294 | 34309 | 1719 |

TABLE 146-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548180 | 2199 | 2214 | TCATGGAGATCTCAGT | eekd$_{10}$kke | 79 | 34298 | 34313 | 1720 |
| 548181 | 2200 | 2215 | GTCATGGAGATCTCAG | eekd$_{10}$kke | 55 | 34299 | 34314 | 1721 |
| 548182 | 2201 | 2216 | AGTCATGGAGATCTCA | eekd$_{10}$kke | 55 | 34300 | 34315 | 1722 |
| 548183 | 2202 | 2217 | CAGTCATGGAGATCTC | eekd$_{10}$kke | 43 | 34301 | 34316 | 1723 |
| 548184 | 2203 | 2218 | ACAGTCATGGAGATCT | eekd$_{10}$kke | 73 | 34302 | 34317 | 1724 |
| 548185 | 2208 | 2223 | AACACACAGTCATGGA | eekd$_{10}$kke | 23 | 34307 | 34322 | 1725 |
| 548186 | 2209 | 2224 | CAACACACAGTCATGG | eekd$_{10}$kke | 0 | 34308 | 34323 | 1726 |
| 548187 | n/a | n/a | CATCCTATCCGTGTTC | eekd$_{10}$kke | 33 | 3279 | 3294 | 1727 |
| 548189 | n/a | n/a | CATGAACATCCTATCC | eekd$_{10}$kke | 24 | 3285 | 3300 | 1728 |
| 548190 | n/a | n/a | TATTCCATGAACATCC | eekd$_{10}$kke | 43 | 3290 | 3305 | 1729 |
| 548191 | n/a | n/a | GTCAACATATTCCATG | eekd$_{10}$kke | 0 | 3297 | 3312 | 1730 |
| 548192 | n/a | n/a | CCTGTCAACATATTCC | eekd$_{10}$kke | 65 | 3300 | 3315 | 1731 |
| 548193 | n/a | n/a | TGTCCTGTCAACATAT | eekd$_{10}$kke | 58 | 3303 | 3318 | 1732 |
| 548194 | n/a | n/a | GCCAACAGTTTCAACT | eekd$_{10}$kke | 61 | 3322 | 3337 | 1733 |
| 548195 | n/a | n/a | TTCTGCCAACAGTTTC | eekd$_{10}$kke | 84 | 3326 | 3341 | 1734 |
| 548196 | n/a | n/a | CAATATTGACTTTGGG | eekd$_{10}$kke | 6 | 3343 | 3358 | 1735 |
| 548197 | n/a | n/a | TGCTTGGCTTCAATAT | eekd$_{10}$kke | 68 | 3353 | 3368 | 1736 |
| 548198 | n/a | n/a | ACTGCAGGCAATATTT | eekd$_{10}$kke | 49 | 3369 | 3384 | 1737 |
| 548199 | n/a | n/a | GCACTGCAGGCAATAT | eekd$_{10}$kke | 24 | 3371 | 3386 | 1738 |
| 548200 | n/a | n/a | CTAATGTGGCACTGCA | eekd$_{10}$kke | 19 | 3379 | 3394 | 1739 |
| 548201 | n/a | n/a | TGTTCTAATGTGGCAC | eekd$_{10}$kke | 67 | 3383 | 3398 | 1740 |
| 548202 | n/a | n/a | GCTGTTCTAATGTGGC | eekd$_{10}$kke | 9 | 3385 | 3400 | 1741 |
| 548203 | n/a | n/a | TGACTAGTGAATGGCT | eekd$_{10}$kke | 73 | 2280 | 2295 | 1742 |
| 548204 | n/a | n/a | TCTGACTAGTGAATGG | eekd$_{10}$kke | 25 | 2282 | 2297 | 1743 |
| 548205 | n/a | n/a | TCAATCTGACTAGTGA | eekd$_{10}$kke | 14 | 2286 | 2301 | 1744 |
| 548206 | n/a | n/a | GGTCAATCTGACTAGT | eekd$_{10}$kke | 45 | 2288 | 2303 | 1745 |
| 548207 | n/a | n/a | CTGGTCAATCTGACTA | eekd$_{10}$kke | 60 | 2290 | 2305 | 1746 |
| 548208 | n/a | n/a | CTCTGGTCAATCTGAC | eekd$_{10}$kke | 19 | 2292 | 2307 | 1747 |
| 548209 | n/a | n/a | CAATCTCTGGTCAATC | eekd$_{10}$kke | 57 | 2296 | 2311 | 1748 |
| 548210 | n/a | n/a | CAACAATCTCTGGTCA | eekd$_{10}$kke | 55 | 2299 | 2314 | 1749 |
| 548211 | n/a | n/a | ACCAACAATCTCTGGT | eekd$_{10}$kke | 51 | 2301 | 2316 | 1750 |
| 548212 | n/a | n/a | AGCCCACCAACAATCT | eekd$_{10}$kke | 44 | 2306 | 2321 | 1751 |
| 548213 | n/a | n/a | GACAGCCCACCAACAA | eekd$_{10}$kke | 70 | 2309 | 2324 | 1752 |
| 548214 | n/a | n/a | CAGACAGCCCACCAAC | eekd$_{10}$kke | 55 | 2311 | 2326 | 1753 |
| 548215 | n/a | n/a | GCATAGACCCCAACAG | eekd$_{10}$kke | 61 | 2324 | 2339 | 1754 |
| 548216 | n/a | n/a | GTGCATAGACCCCAAC | eekd$_{10}$kke | 45 | 2326 | 2341 | 1755 |
| 548217 | n/a | n/a | CTGTGCATAGACCCCA | eekd$_{10}$kke | 69 | 2328 | 2343 | 1756 |

TABLE 146-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548218 | n/a | n/a | TCCTGTGCATAGACCC | eekd$_{10}$kke | 59 | 2330 | 2345 | 1757 |
| 548219 | n/a | n/a | GAAATCCTGTGCATAG | eekd$_{10}$kke | 8 | 2334 | 2349 | 1758 |
| 548220 | n/a | n/a | GCAGAAATCCTGTGCA | eekd$_{10}$kke | 69 | 2337 | 2352 | 1759 |
| 548221 | n/a | n/a | ACTCCAGCAGAAATCC | eekd$_{10}$kke | 49 | 2343 | 2358 | 1760 |
| 548222 | n/a | n/a | AATCATGCCTTGTGGG | eekd$_{10}$kke | 32 | 4765 | 4780 | 1761 |
| 548223 | n/a | n/a | TAGACCCAGAATCATG | eekd$_{10}$kke | 50 | 4774 | 4789 | 1762 |
| 548224 | n/a | n/a | CCATAGACCCAGAATC | eekd$_{10}$kke | 20 | 4777 | 4792 | 1763 |
| 548225 | n/a | n/a | AGTCACCATAGACCCA | eekd$_{10}$kke | 48 | 4782 | 4797 | 1764 |
| 548226 | n/a | n/a | TAAGTCACCATAGACC | eekd$_{10}$kke | 39 | 4784 | 4799 | 1765 |
| 548227 | n/a | n/a | GTGGCCCTCTTAAGTC | eekd$_{10}$kke | 0 | 4794 | 4809 | 1766 |

TABLE 147

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 42 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547747 | n/a | n/a | TCACTGTACTAGTTTC | eekd$_{10}$kke | 80 | 14746 14817 14888 14947 15007 15079 15222 15294 15353 15413 15485 15557 15615 15687 15817 15889 15947 | 14761 14832 14903 14962 15022 15094 15237 15309 15368 15428 15500 15572 15630 15702 15832 15904 15962 | 1267 |
| 548228 | n/a | n/a | GTTGTGTGGCCCTCTT | eekd$_{10}$kke | 37 | 4799 | 4814 | 1767 |
| 548229 | n/a | n/a | CATTGTTGTGTGGCCC | eekd$_{10}$kke | 31 | 4803 | 4818 | 1768 |

TABLE 147-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548230 | n/a | n/a | TACTCATTGTTGTGTG | eekd$_{10}$kke | 10 | 4807 | 4822 | 1769 |
| 548231 | n/a | n/a | AATACTCATTGTTGTG | eekd$_{10}$kke | 11 | 4809 | 4824 | 1770 |
| 548232 | n/a | n/a | GCCATACATCTGAGGA | eekd$_{10}$kke | 3 | 4831 | 4846 | 1771 |
| 548233 | n/a | n/a | ATTGTAGCCATACATC | eekd$_{10}$kke | 38 | 4837 | 4852 | 1772 |
| 548234 | n/a | n/a | TTATTGTAGCCATACA | eekd$_{10}$kke | 17 | 4839 | 4854 | 1773 |
| 548235 | n/a | n/a | TCTAGATGACCTGAAG | eekd$_{10}$kke | 0 | 18147 | 18162 | 1774 |
| 548236 | n/a | n/a | TACATCTAGATGACCT | eekd$_{10}$kke | 37 | 18151 | 18166 | 1775 |
| 548237 | n/a | n/a | GTATACATCTAGATGA | eekd$_{10}$kke | 22 | 18154 | 18169 | 1776 |
| 548238 | n/a | n/a | ACTCGCCTTTGTGACT | eekd$_{10}$kke | 31 | 26268 | 26283 | 1777 |
| 548239 | n/a | n/a | TACTCGCCTTTGTGAC | eekd$_{10}$kke | 18 | 26269 | 26284 | 1778 |
| 548240 | n/a | n/a | ATACTCGCCTTTGTGA | eekd$_{10}$kke | 3 | 26270 26301 | 26285 26316 | 1779 |
| 548241 | n/a | n/a | CATACTCGCCTTTGTG | eekd$_{10}$kke | 1 | 26271 26302 | 26286 26317 | 1780 |
| 548242 | n/a | n/a | GCATACTCGCCTTTGT | eekd$_{10}$kke | 25 | 26272 26303 | 26287 26318 | 1781 |
| 548243 | n/a | n/a | ATGCATACTCGCCTTT | eekd$_{10}$kke | 0 | 26274 26305 | 26289 26320 | 1782 |
| 548244 | n/a | n/a | CATGCATACTCGCCTT | eekd$_{10}$kke | 51 | 26275 26306 | 26290 26321 | 1783 |
| 548245 | n/a | n/a | CCATGCATACTCGCCT | eekd$_{10}$kke | 31 | 26276 26307 | 26291 26322 | 1784 |
| 548246 | n/a | n/a | TTCCATGCATACTCGC | eekd$_{10}$kke | 46 | 26278 | 26293 | 1785 |
| 548247 | n/a | n/a | CGATTTTCCATGCATA | eekd$_{10}$kke | 56 | 26283 | 26298 | 1786 |
| 548248 | n/a | n/a | TGCGATTTTCCATGCA | eekd$_{10}$kke | 13 | 26285 | 26300 | 1787 |
| 548249 | n/a | n/a | TGTGATGCGATTTTCC | eekd$_{10}$kke | 22 | 26290 | 26305 | 1788 |
| 548250 | n/a | n/a | CTTTGTGATGCGATTT | eekd$_{10}$kke | 0 | 26293 | 26308 | 1789 |
| 548251 | n/a | n/a | GCCTTTGTGATGCGAT | eekd$_{10}$kke | 13 | 26295 | 26310 | 1790 |
| 548252 | n/a | n/a | ACTCGCCTTTGTGATG | eekd$_{10}$kke | 33 | 26299 | 26314 | 1791 |
| 548253 | n/a | n/a | TACTCGCCTTTGTGAT | eekd$_{10}$kke | 8 | 26300 | 26315 | 1792 |
| 548254 | n/a | n/a | CCCATGCATACTCGCC | eekd$_{10}$kke | 39 | 26308 | 26323 | 1793 |
| 548255 | n/a | n/a | CCCCATGCATACTCGC | eekd$_{10}$kke | 38 | 26309 | 26324 | 1794 |
| 548256 | n/a | n/a | GCTCCCCATGCATACT | eekd$_{10}$kke | 25 | 26312 | 26327 | 1795 |
| 548257 | n/a | n/a | AGTGCTCCCCATGCAT | eekd$_{10}$kke | 2 | 26315 | 26330 | 1796 |
| 548258 | n/a | n/a | CAAGTGCTCCCCATGC | eekd$_{10}$kke | 0 | 26317 | 26332 | 1797 |
| 548259 | n/a | n/a | GTGATGAAAGTACAGC | eekd$_{10}$kke | 45 | 26335 | 26350 | 1798 |
| 548260 | n/a | n/a | AGGAGTTTGTCAGAAC | eekd$_{10}$kke | 28 | 3210 | 3225 | 1799 |
| 548261 | n/a | n/a | TTCAGGGAGTGATGTC | eekd$_{10}$kke | 36 | 3241 | 3256 | 1800 |
| 548262 | n/a | n/a | CCTATCCGTGTTCAGC | eekd$_{10}$kke | 73 | 3276 | 3291 | 1801 |
| 548263 | n/a | n/a | CTCTACATACTCAGGA | eekd$_{10}$kke | 62 | 3561 | 3576 | 1802 |

TABLE 147-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548264 | n/a | n/a | CAGTCCAAAAATCCCT | eekd$_{10}$kke | 60 | 3701 | 3716 | 1803 |
| 548265 | n/a | n/a | CCTCTTGATTTGGGCA | eekd$_{10}$kke | 85 | 3749 | 3764 | 1804 |
| 548266 | n/a | n/a | TTGGCCAACTCTGTGG | eekd$_{10}$kke | 44 | 3816 | 3831 | 1805 |
| 548267 | n/a | n/a | GACCTCCAGACTACTG | eekd$_{10}$kke | 34 | 3848 | 3863 | 1806 |
| 548268 | n/a | n/a | TGTGTCTAGGGAGTTG | eekd$_{10}$kke | 52 | 3898 | 3913 | 1807 |
| 548269 | n/a | n/a | AGCACACAATTACTGG | eekd$_{10}$kke | 62 | 3946 | 3961 | 1808 |
| 548270 | n/a | n/a | CTGCTGGTTTTAGACC | eekd$_{10}$kke | 28 | 4029 | 4044 | 1809 |
| 548271 | n/a | n/a | TTCACTTACCACAGGA | eekd$_{10}$kke | 56 | 4122 | 4137 | 1810 |
| 548272 | n/a | n/a | GGTGCCACTTGCTTGG | eekd$_{10}$kke | 54 | 4178 | 4193 | 1811 |
| 548273 | n/a | n/a | AATCTCCACCCCCGAA | eekd$_{10}$kke | 5 | 4224 | 4239 | 1812 |
| 548274 | n/a | n/a | TACCTGACAAGTGGTC | eekd$_{10}$kke | 0 | 4287 | 4302 | 1813 |
| 548275 | n/a | n/a | GTCCCAAGACATTCCT | eekd$_{10}$kke | 40 | 4350 | 4365 | 1814 |
| 548276 | n/a | n/a | CAGAGTGTCATCTGCG | eekd$_{10}$kke | 49 | 4389 | 4404 | 1815 |
| 548277 | n/a | n/a | GGATTGGACCCAGACA | eekd$_{10}$kke | 57 | 4511 | 4526 | 1816 |
| 548278 | n/a | n/a | GGTTCCCTAGCGGTCC | eekd$_{10}$kke | 74 | 4564 | 4579 | 1817 |
| 548279 | n/a | n/a | CACCTAGAACTATCCA | eekd$_{10}$kke | 39 | 4632 | 4647 | 1818 |
| 548280 | n/a | n/a | CTCCCTCTGTAATGAT | eekd$_{10}$kke | 43 | 4736 | 4751 | 1819 |
| 548281 | n/a | n/a | GGTTGAGGGACAGACA | eekd$_{10}$kke | 0 | 4944 | 4959 | 1820 |
| 548282 | n/a | n/a | GTGGGTTTGCACATGG | eekd$_{10}$kke | 73 | 4992 | 5007 | 1821 |
| 548283 | n/a | n/a | GGCTTATGCTCCTTCT | eekd$_{10}$kke | 56 | 5017 | 5032 | 1822 |
| 548284 | n/a | n/a | CCCCCTGTAGTTGGCT | eekd$_{10}$kke | 35 | 5051 | 5066 | 1823 |
| 548285 | n/a | n/a | GCTTACTTACATCCCT | eekd$_{10}$kke | 52 | 5132 | 5147 | 1824 |
| 548286 | n/a | n/a | GGGACTACATGCAATA | eekd$_{10}$kke | 47 | 5166 | 5181 | 1825 |
| 548287 | n/a | n/a | GTCAAAGAGTGTCCAC | eekd$_{10}$kke | 38 | 5283 | 5298 | 1826 |
| 548288 | n/a | n/a | GAATAGCAAGCTCCAA | eekd$_{10}$kke | 64 | 5348 | 5363 | 1827 |
| 548289 | n/a | n/a | CATGATACCACACCAC | eekd$_{10}$kke | 28 | 5484 | 5499 | 1828 |
| 548290 | n/a | n/a | GAGCACTCTTATTAGC | eekd$_{10}$kke | 31 | 5546 | 5561 | 1829 |
| 548291 | n/a | n/a | CCTGTTAGAGTTGGCC | eekd$_{10}$kke | 35 | 5576 | 5591 | 1830 |
| 548292 | n/a | n/a | AGGACACTGTTTCCAG | eekd$_{10}$kke | 38 | 5627 | 5642 | 1831 |
| 548293 | n/a | n/a | GTCACCAGAACCACAT | eekd$_{10}$kke | 44 | 5683 | 5698 | 1832 |
| 548294 | n/a | n/a | GTGTGCACTTTCTGGT | eekd$_{10}$kke | 33 | 5716 | 5731 | 1833 |
| 548295 | n/a | n/a | CTCTGATTGGGTCACC | eekd$_{10}$kke | 26 | 5746 | 5761 | 1834 |
| 548296 | n/a | n/a | ACCAACAACTCAGGCC | eekd$_{10}$kke | 34 | 5858 | 5873 | 1835 |
| 548297 | n/a | n/a | ACTCTCAAGCTCCACG | eekd$_{10}$kke | 32 | 5889 | 5904 | 1836 |
| 548298 | n/a | n/a | GGACAATATGTCTCCT | eekd$_{10}$kke | 0 | 5935 | 5950 | 1837 |
| 548299 | n/a | n/a | CATTGTGCTCAACTGA | eekd$_{10}$kke | 35 | 5961 | 5976 | 1838 |

TABLE 147-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548300 | n/a | n/a | GCCCATGGTGAATCTG | eekd$_{10}$kke | 53 | 5995 | 6010 | 1839 |
| 548301 | n/a | n/a | CCTAGTACAAAGTGGC | eekd$_{10}$kke | 65 | 6050 | 6065 | 1840 |
| 548302 | n/a | n/a | GCCATTTTATCCCTGA | eekd$_{10}$kke | 71 | 6134 | 6149 | 1841 |
| 548303 | n/a | n/a | GGGCCCCCATGTCCAT | eekd$_{10}$kke | 0 | 6336 | 6351 | 1842 |

TABLE 148

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 72 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547747 | n/a | n/a | TCACTGTACTAGTTTC | eekd$_{10}$kke | 67 | 14746 14817 14888 14947 15007 15079 15222 15294 15353 15413 15485 15557 15615 15687 15817 15889 15947 | 14761 14832 14903 14962 15022 15094 15237 15309 15368 15428 15500 15572 15630 15702 15832 15904 15962 | 1267 |
| 548305 | n/a | n/a | GTTCTTGCTTATCCTC | eekd$_{10}$kke | 55 | 6484 | 6499 | 1843 |
| 548306 | n/a | n/a | ATGTGACAGTCAGGGA | eekd$_{10}$kke | 8 | 6559 | 6574 | 1844 |
| 548307 | n/a | n/a | TTCTGCAACTGAGCCT | eekd$_{10}$kke | 6 | 6587 | 6602 | 1845 |
| 548308 | n/a | n/a | AATGGCAGGTCCTGGC | eekd$_{10}$kke | 9 | 6616 | 6631 | 1846 |
| 548309 | n/a | n/a | AGACAGTTGGTGGTTT | eekd$_{10}$kke | 41 | 6700 | 6715 | 1847 |
| 548310 | n/a | n/a | GAGGAGTGGTTTAGT | eekd$_{10}$kke | 0 | 6750 | 6765 | 1848 |
| 548311 | n/a | n/a | TGACCACCTCTCGGGT | eekd$_{10}$kke | 10 | 6860 | 6875 | 1849 |
| 548312 | n/a | n/a | ATTTGGCCCTGAGCCC | eekd$_{10}$kke | 0 | 6935 | 6950 | 1850 |
| 548313 | n/a | n/a | GCCTTTGAGGGAGTGG | eekd$_{10}$kke | 35 | 7024 | 7039 | 1851 |

TABLE 148-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548314 | n/a | n/a | ACAACCTGTCCATTCC | eekd$_{10}$kke | 43 | 7087 | 7102 | 1852 |
| 548315 | n/a | n/a | GTTGTCAACTGGGACC | eekd$_{10}$kke | 14 | 7125 | 7140 | 1853 |
| 548316 | n/a | n/a | CTGTTCAGGTAGCACA | eekd$_{10}$kke | 64 | 7150 | 7165 | 1854 |
| 548317 | n/a | n/a | CCGGGAAAGACTGTCT | eekd$_{10}$kke | 42 | 7190 | 7205 | 1855 |
| 548318 | n/a | n/a | ACTGCACCCCACATAT | eekd$_{10}$kke | 18 | 7257 | 7272 | 1856 |
| 548319 | n/a | n/a | CCTCATCTCAGTATGA | eekd$_{10}$kke | 26 | 7398 | 7413 | 1857 |
| 548320 | n/a | n/a | GCACACAGACTTGCCC | eekd$_{10}$kke | 0 | 7508 | 7523 | 1858 |
| 548321 | n/a | n/a | CTGCATCTGGACTATG | eekd$_{10}$kke | 38 | 7559 | 7574 | 1859 |
| 548322 | n/a | n/a | AGGGAAATTAGAGGCA | eekd$_{10}$kke | 38 | 7586 | 7601 | 1860 |
| 548323 | n/a | n/a | CTGTTGCCTGACATGC | eekd$_{10}$kke | 43 | 7696 | 7711 | 1861 |
| 548324 | n/a | n/a | ACATAAATTCCCCACA | eekd$_{10}$kke | 29 | 7741 | 7756 | 1862 |
| 548325 | n/a | n/a | CCCACTGACTGACTAC | eekd$_{10}$kke | 27 | 7906 | 7921 | 1863 |
| 548326 | n/a | n/a | TCCTGTGACAGAACCA | eekd$_{10}$kke | 27 | 7988 | 8003 | 1864 |
| 548327 | n/a | n/a | CTACACCTTTCTGCAC | eekd$_{10}$kke | 6 | 8221 | 8236 | 1865 |
| 548328 | n/a | n/a | GGTCCTTGAACCCCGT | eekd$_{10}$kke | 68 | 8260 | 8275 | 1866 |
| 548329 | n/a | n/a | AGCAGATCTGGGTTGT | eekd$_{10}$kke | 59 | 8328 | 8343 | 1867 |
| 548330 | n/a | n/a | GACTAGCTTCTACTAC | eekd$_{10}$kke | 34 | 8404 | 8419 | 1868 |
| 548331 | n/a | n/a | ACAATCCCTTAGCCCA | eekd$_{10}$kke | 73 | 8457 | 8472 | 1869 |
| 548332 | n/a | n/a | GATGAAATGTGCACCT | eekd$_{10}$kke | 46 | 8491 | 8506 | 1870 |
| 548333 | n/a | n/a | GACTGTGCTATCCGCT | eekd$_{10}$kke | 58 | 8550 | 8565 | 1871 |
| 548334 | n/a | n/a | GCTCACTATAGGCCCC | eekd$_{10}$kke | 69 | 8656 | 8671 | 1872 |
| 548335 | n/a | n/a | TAGCATCATGCCACAG | eekd$_{10}$kke | 51 | 8684 | 8699 | 1873 |
| 548336 | n/a | n/a | GCACATTAGGAGGTAG | eekd$_{10}$kke | 1 | 9039 | 9054 | 1874 |
| 548337 | n/a | n/a | TACCGCTGGGTGCGGT | eekd$_{10}$kke | 10 | 9075 | 9090 | 1875 |
| 548338 | n/a | n/a | ATGAAACTGTGGCTCG | eekd$_{10}$kke | 80 | 9131 | 9146 | 1876 |
| 548339 | n/a | n/a | ACATGTGGGATCAGAG | eekd$_{10}$kke | 37 | 9275 | 9290 | 1877 |
| 548340 | n/a | n/a | GATGATCCTCACATAC | eekd$_{10}$kke | 35 | 9316 | 9331 | 1878 |
| 548341 | n/a | n/a | TAGAACCTTCCTCCAC | eekd$_{10}$kke | 30 | 9341 | 9356 | 1879 |
| 548342 | n/a | n/a | GGAAGACTTCCCTCTG | eekd$_{10}$kke | 0 | 9403 | 9418 | 1880 |
| 548343 | n/a | n/a | TAGTGATAAGAGCTGG | eekd$_{10}$kke | 78 | 9472 | 9487 | 1881 |
| 548344 | n/a | n/a | GGCAACTATGTTCTCA | eekd$_{10}$kke | 76 | 9536 | 9551 | 1882 |
| 548345 | n/a | n/a | CTAACTCCATCACTGC | eekd$_{10}$kke | 55 | 9637 | 9652 | 1883 |
| 548346 | n/a | n/a | TCCCCAATACTTGCTG | eekd$_{10}$kke | 35 | 9696 | 9711 | 1884 |
| 548347 | n/a | n/a | GCTGTTCTAAGCGAGA | eekd$_{10}$kke | 31 | 9976 | 9991 | 1885 |
| 548348 | n/a | n/a | TGAGTGATGCCTTCCA | eekd$_{10}$kke | 82 | 10024 | 10039 | 1886 |
| 548349 | n/a | n/a | TCCAGAATACTGCCCC | eekd$_{10}$kke | 61 | 10054 | 10069 | 1887 |

TABLE 148-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548350 | n/a | n/a | GCGCTAACCTCATAAA | eekd$_{10}$kke | 29 | 10148 | 10163 | 1888 |
| 548351 | n/a | n/a | CTGGAAACGAGACACA | eekd$_{10}$kke | 33 | 10201 | 10216 | 1889 |
| 548352 | n/a | n/a | GAGAGAGATGTTCCCT | eekd$_{10}$kke | 47 | 10240 | 10255 | 1890 |
| 548353 | n/a | n/a | CTGCTGGTTGAGAATC | eekd$_{10}$kke | 48 | 10287 | 10302 | 1891 |
| 548354 | n/a | n/a | ATGTCCCCAGTGGAAG | eekd$_{10}$kke | 41 | 10314 | 10329 | 1892 |
| 548355 | n/a | n/a | GCATCCTCCCTAGTTG | eekd$_{10}$kke | 47 | 10362 | 10377 | 1893 |
| 548356 | n/a | n/a | TGTTGGTCAGCATTCA | eekd$_{10}$kke | 63 | 10411 | 10426 | 1894 |
| 548357 | n/a | n/a | GACGACTGCCCTGTGC | eekd$_{10}$kke | 69 | 10436 | 10451 | 1895 |
| 548358 | n/a | n/a | ATTTGGGCCTAGTGGT | eekd$_{10}$kke | 0 | 10515 | 10530 | 1896 |
| 548359 | n/a | n/a | CCTAGTCCTCAAGTTT | eekd$_{10}$kke | 0 | 10580 | 10595 | 1897 |
| 548360 | n/a | n/a | CAAGACATCAGTAGCT | eekd$_{10}$kke | 45 | 10626 | 10641 | 1898 |
| 548361 | n/a | n/a | CTTATCAGTCCCAGTC | eekd$_{10}$kke | 52 | 10702 | 10717 | 1899 |
| 548362 | n/a | n/a | GACAACCCATCAGTTG | eekd$_{10}$kke | 33 | 10742 | 10757 | 1900 |
| 548363 | n/a | n/a | CAGCAGGCTCAAAGTG | eekd$_{10}$kke | 37 | 10915 | 10930 | 1901 |
| 548364 | n/a | n/a | TGGCTAAGTCAGGCCC | eekd$_{10}$kke | 30 | 10982 | 10997 | 1902 |
| 548365 | n/a | n/a | TGTACTCCACCTCACG | eekd$_{10}$kke | 55 | 11017 | 11032 | 1903 |
| 548366 | n/a | n/a | AGCAAGCTAAGTGAGT | eekd$_{10}$kke | 5 | 11199 | 11214 | 1904 |
| 548367 | n/a | n/a | GTTCTTGAGTGTAGAG | eekd$_{10}$kke | 52 | 11260 | 11275 | 1905 |
| 548368 | n/a | n/a | GTGTTCATACGGAAGC | eekd$_{10}$kke | 59 | 11299 | 11314 | 1906 |
| 548369 | n/a | n/a | GTTGGGATGCGACTCT | eekd$_{10}$kke | 50 | 11335 | 11350 | 1907 |
| 548370 | n/a | n/a | ACGAAGTCTCTTTCCT | eekd$_{10}$kke | 53 | 11385 | 11400 | 1908 |
| 548371 | n/a | n/a | CGATGAGTTGGGCAGG | eekd$_{10}$kke | 57 | 11454 | 11469 | 1909 |
| 548372 | n/a | n/a | GATACCTTTCCACTCC | eekd$_{10}$kke | 61 | 11558 | 11573 | 1910 |
| 548373 | n/a | n/a | TCCCCAAGATTATGTG | eekd$_{10}$kke | 16 | 11596 | 11611 | 1911 |
| 548374 | n/a | n/a | GCACCCTTTTCATTGA | eekd$_{10}$kke | 41 | 12074 | 12089 | 1912 |
| 548375 | n/a | n/a | TCGACTTCTCCTGTCT | eekd$_{10}$kke | 27 | 12199 | 12214 | 1913 |
| 548376 | n/a | n/a | GCCTTTGACCTTTCGC | eekd$_{10}$kke | 65 | 12261 | 12276 | 1914 |
| 548377 | n/a | n/a | GTGTGCTGAGGTTTGC | eekd$_{10}$kke | 80 | 12297 | 12312 | 1915 |
| 548378 | n/a | n/a | GCAAGATGCATGCAGC | eekd$_{10}$kke | 49 | 12393 | 12408 | 1916 |
| 548379 | n/a | n/a | ATCGAACTCTGCTTGA | eekd$_{10}$kke | 44 | 12477 | 12492 | 1917 |
| 548380 | n/a | n/a | GCCCAGTTTTGGCAAC | eekd$_{10}$kke | 7 | 12540 | 12555 | 1918 |
| 548381 | n/a | n/a | CCCACTACCATTTGGG | eekd$_{10}$kke | 0 | 12578 | 12593 | 1919 |

TABLE 149

| ISIS NO | SEQ ID NO: 1 Start Site | SEQ ID NO: 1 Stop Site | Sequence | Chemistry | % inhi-bition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTTTCCT | eeeeed$_{10}$eeeee | 46 | 14744<br>14815<br>14886<br>14945<br>15005<br>15077<br>15220<br>15292<br>15351<br>15411<br>15483<br>15555<br>15613<br>15685<br>15815<br>15887<br>15945 | 14763<br>14834<br>14905<br>14964<br>15024<br>15096<br>15239<br>15311<br>15370<br>15430<br>15502<br>15574<br>15632<br>15704<br>15834<br>15906<br>15964 | 334 |
| 547747 | n/a | n/a | TCACTGTACTAGTTTC | eekd$_{10}$kke | 64 | 14746<br>14817<br>14888<br>14947<br>15007<br>15079<br>15222<br>15294<br>15353<br>15413<br>15485<br>15557<br>15615<br>15687<br>15817<br>15889<br>15947 | 14761<br>14832<br>14903<br>14962<br>15022<br>15094<br>15237<br>15309<br>15368<br>15428<br>15500<br>15572<br>15630<br>15702<br>15832<br>15904<br>15962 | 1267 |
| 548459 | n/a | n/a | CAACTATAACAGTATC | eekd$_{10}$kke | 26 | 15903 | 15918 | 1920 |
| 548460 | n/a | n/a | CTATACCACGGTAACT | eekd$_{10}$kke | 0 | 16036 | 16051 | 1921 |
| 548461 | n/a | n/a | CCTATATCACTGTAAC | eekd$_{10}$kke | 0 | 16127 | 16142 | 1922 |
| 548462 | n/a | n/a | ACCTATATCACTGTAA | eekd$_{10}$kke | 0 | 16128 | 16143 | 1923 |
| 548463 | n/a | n/a | TCACTGTACCTATATC | eekd$_{10}$kke | 0 | 16135 | 16150 | 1924 |
| 548464 | n/a | n/a | GTCCTATAACTATATC | eekd$_{10}$kke | 0 | 16174 | 16189 | 1925 |
| 548465 | n/a | n/a | CTGTACCTATAACTGT | eekd$_{10}$kke | 0 | 16202 | 16217 | 1926 |
| 548466 | n/a | n/a | CGTCACTGTACCTATA | eekd$_{10}$kke | 71 | 16207 | 16222 | 1927 |
| 548467 | n/a | n/a | CATCACTGTACCTATA | eekd$_{10}$kke | 20 | 16258 | 16273 | 1928 |
| 548468 | n/a | n/a | CAACATCACTGTACCT | eekd$_{10}$kke | 6 | 16261 | 16276 | 1929 |
| 548469 | n/a | n/a | TTCCCTACCCCTGGTA | eekd$_{10}$kke | 0 | 16331 | 16346 | 1930 |
| 548470 | n/a | n/a | GGTGGAATGTCATGGC | eekd$_{10}$kke | 56 | 16404 | 16419 | 1931 |
| 548471 | n/a | n/a | GCGGAAAACTGGCCGT | eekd$_{10}$kke | 17 | 16474 | 16489 | 1932 |
| 548472 | n/a | n/a | CCCAATACAGGGCCAG | eekd$_{10}$kke | 0 | 16513 | 16528 | 1933 |
| 548473 | n/a | n/a | CCAACCTTCCCAATCT | eekd$_{10}$kke | 0 | 16554 | 16569 | 1934 |
| 548474 | n/a | n/a | GAAGGTGTGCTGTCGC | eekd$_{10}$kke | 33 | 16602 | 16617 | 1935 |
| 548475 | n/a | n/a | ATCGAGTCCTGCCTCC | eekd$_{10}$kke | 17 | 16707 | 16722 | 1936 |
| 548476 | n/a | n/a | GCAAATCCTTCCAGCA | eekd$_{10}$kke | 27 | 16755 | 16770 | 1937 |
| 548477 | n/a | n/a | GCACGAGCTTGCCTGT | eekd$_{10}$kke | 26 | 16787 | 16802 | 1938 |

TABLE 149-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548478 | n/a | n/a | GAGCCATCCAGGGTGC | eekd$_{10}$kke | 53 | 16845 | 16860 | 1939 |
| 548479 | n/a | n/a | AGGCCATTTGATCCGA | eekd$_{10}$kke | 68 | 16913 | 16928 | 1940 |
| 548480 | n/a | n/a | GCCACGCCCTTAGCAG | eekd$_{10}$kke | 20 | 16973 | 16988 | 1941 |
| 548481 | n/a | n/a | GTTCCCTGAGGAACGG | eekd$_{10}$kke | 2 | 17010 | 17025 | 1942 |
| 548482 | n/a | n/a | GGCAGTTAGGCCAGGA | eekd$_{10}$kke | 53 | 17068 | 17083 | 1943 |
| 548483 | n/a | n/a | CTACAGATCATCCCTA | eekd$_{10}$kke | 5 | 17102 | 17117 | 1944 |
| 548484 | n/a | n/a | CCCCGGAGCACCTTCA | eekd$_{10}$kke | 41 | 17207 | 17222 | 1945 |
| 548485 | n/a | n/a | GTGACCCAAGGGTCGA | eekd$_{10}$kke | 17 | 17252 | 17267 | 1946 |
| 548486 | n/a | n/a | CGTGGTTAGCCTGACA | eekd$_{10}$kke | 68 | 17416 | 17431 | 1947 |
| 548487 | n/a | n/a | TCCATGTCAGAGTTGC | eekd$_{10}$kke | 71 | 17461 | 17476 | 1948 |
| 548488 | n/a | n/a | CCTCCTTTTGGCTTGA | eekd$_{10}$kke | 63 | 17530 | 17545 | 1949 |
| 548489 | n/a | n/a | TTCCCCAGAGGTGATA | eekd$_{10}$kke | 16 | 17582 | 17597 | 1950 |
| 548490 | n/a | n/a | TCTGGTTAGCCTCCGA | eekd$_{10}$kke | 58 | 17664 | 17679 | 1951 |
| 548491 | n/a | n/a | TGGCCAAGCAACCAGT | eekd$_{10}$kke | 57 | 17715 | 17730 | 1952 |
| 548492 | n/a | n/a | GCCCAATGTCCTAACC | eekd$_{10}$kke | 51 | 17794 | 17809 | 1953 |
| 548493 | n/a | n/a | CCACCGCTGCCCGCCA | eekd$_{10}$kke | 37 | 18013 | 18028 | 1954 |
| 548494 | n/a | n/a | TGTGACCCCCACCGC | eekd$_{10}$kke | 39 | 18022 | 18037 | 1955 |
| 548495 | n/a | n/a | TTGTGACCCCCACCG | eekd$_{10}$kke | 55 | 18023 | 18038 | 1956 |
| 548496 | n/a | n/a | ACTGAACCCCCTTAGG | eekd$_{10}$kke | 0 | 18571 | 18586 | 1957 |
| 548497 | n/a | n/a | CCTTCATACCCCTCAC | eekd$_{10}$kke | 26 | 18725 | 18740 | 1958 |
| 548498 | n/a | n/a | CCGATAACAGACCGGC | eekd$_{10}$kke | 71 | 18795 | 18810 | 1959 |
| 548499 | n/a | n/a | ATACCCGGAGTCAGGA | eekd$_{10}$kke | 56 | 18955 | 18970 | 1960 |
| 548500 | n/a | n/a | ATTGCTCAGGCCCCCT | eekd$_{10}$kke | 29 | 19037 | 19052 | 1961 |
| 548501 | n/a | n/a | CAAGCCACTAACCCAC | eekd$_{10}$kke | 33 | 19147 | 19162 | 1962 |
| 548502 | n/a | n/a | AATTCTTGGACCAAGG | eekd$_{10}$kke | 25 | 19234 | 19249 | 1963 |
| 548503 | n/a | n/a | CCATCTACTCCCCCAT | eekd$_{10}$kke | 9 | 19291 | 19306 | 1964 |
| 548504 | n/a | n/a | GCAGCGAGCATTCCAA | eekd$_{10}$kke | 28 | 19352 | 19367 | 1965 |
| 548505 | n/a | n/a | GGACAATGCCTATGCT | eekd$_{10}$kke | 21 | 19386 | 19401 | 1966 |
| 548506 | n/a | n/a | GAAGCCATTCACTGCA | eekd$_{10}$kke | 32 | 19436 | 19451 | 1967 |
| 548507 | n/a | n/a | AAACTCCTCTCAAGGC | eekd$_{10}$kke | 53 | 19474 | 19489 | 1968 |
| 548508 | n/a | n/a | GCACCACCATGCGGTT | eekd$_{10}$kke | 43 | 19553 | 19568 | 1969 |
| 548509 | n/a | n/a | TGCAGGGCTGCGCAGT | eekd$_{10}$kke | 41 | 19960 | 19975 | 1970 |
| 548510 | n/a | n/a | TTAGCCACTCCTCTTG | eekd$_{10}$kke | 30 | 20062 | 20077 | 1971 |
| 548511 | n/a | n/a | AGCTAGCTGACCCCAA | eekd$_{10}$kke | 16 | 20092 | 20107 | 1972 |
| 548512 | n/a | n/a | TCCGCCTTTGGATACT | eekd$_{10}$kke | 49 | 20155 | 20170 | 1973 |
| 548513 | n/a | n/a | CCTGCTGATTGTGTCT | eekd$_{10}$kke | 16 | 20240 | 20255 | 1974 |

TABLE 149-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
| --- | --- | --- | --- | --- | --- | --- | --- | --- |
| 548514 | n/a | n/a | TCGAGGACAGCCCCCA | eekd$_{10}$kke | 40 | 20335 | 20350 | 1975 |
| 548515 | n/a | n/a | ACCCGTCAGCCTCAGC | eekd$_{10}$kke | 59 | 20381 | 20396 | 1976 |
| 548516 | n/a | n/a | CTTGCCTATTCACCCC | eekd$_{10}$kke | 49 | 20544 | 20559 | 1977 |
| 548517 | n/a | n/a | CGGACAAGCCTTACAG | eekd$_{10}$kke | 43 | 20596 | 20611 | 1978 |
| 548518 | n/a | n/a | CACACTTACCCCGCTC | eekd$_{10}$kke | 12 | 20741 | 20756 | 1979 |
| 548519 | n/a | n/a | CCTCCCCTTGTGTGTC | eekd$_{10}$kke | 31 | 20843 | 20858 | 1980 |
| 548520 | n/a | n/a | CCGCTTCCCTGACTGT | eekd$_{10}$kke | 43 | 20919 | 20934 | 1981 |
| 548521 | n/a | n/a | CAGCTCCCTTACTAGG | eekd$_{10}$kke | 61 | 20958 | 20973 | 1982 |
| 548522 | n/a | n/a | AGGTATTGACCGCCAG | eekd$_{10}$kke | 55 | 21062 | 21077 | 1983 |
| 548523 | n/a | n/a | GGTAAATCCATCCCCT | eekd$_{10}$kke | 44 | 21157 | 21172 | 1984 |
| 548524 | n/a | n/a | GCCCGATCACCTTAGA | eekd$_{10}$kke | 45 | 21220 | 21235 | 1985 |
| 548525 | n/a | n/a | GTCTAACTGGCCTGGC | eekd$_{10}$kke | 2 | 21328 | 21343 | 1986 |
| 548526 | n/a | n/a | CTAAGCTGTGTCTCAT | eekd$_{10}$kke | 26 | 21373 | 21388 | 1987 |
| 548527 | n/a | n/a | TGTTTCAAGTGCCAGA | eekd$_{10}$kke | 50 | 21434 | 21449 | 1988 |
| 548528 | n/a | n/a | TGCAGTGGTCAAGCAT | eekd$_{10}$kke | 32 | 21478 | 21493 | 1989 |
| 548529 | n/a | n/a | GCGATTCCTTGCCTCT | eekd$_{10}$kke | 56 | 21554 | 21569 | 1990 |
| 548530 | n/a | n/a | ATAATAGAGGCAGCCA | eekd$_{10}$kke | 50 | 21592 | 21607 | 1991 |
| 548531 | n/a | n/a | GTCAGAAGGCCTCTTA | eekd$_{10}$kke | 21 | 21753 | 21768 | 1992 |
| 548532 | n/a | n/a | TATTTATCCGACCTCT | eekd$_{10}$kke | 34 | 21881 | 21896 | 1993 |
| 548533 | n/a | n/a | GAGGTGGTTGGAGCTA | eekd$_{10}$kke | 9 | 21926 | 21941 | 1994 |
| 548534 | n/a | n/a | CAGATCCCAATTCTTC | eekd$_{10}$kke | 22 | 22063 | 22078 | 1995 |
| 548535 | n/a | n/a | GAGTCTTTCCAATCCT | eekd$_{10}$kke | 13 | 22142 | 22157 | 1996 |

TABLE 150

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
| --- | --- | --- | --- | --- | --- | --- | --- | --- |
| 531231 | n/a | n/a | TATCACTGTACTAGTTTCCT | eeeeed$_{10}$eeeee | 46 | 14744 | 14763 | 334 |
| | | | | | | 14815 | 14834 | |
| | | | | | | 14886 | 14905 | |
| | | | | | | 14945 | 14964 | |
| | | | | | | 15005 | 15024 | |
| | | | | | | 15077 | 15096 | |
| | | | | | | 15220 | 15239 | |
| | | | | | | 15292 | 15311 | |
| | | | | | | 15351 | 15370 | |
| | | | | | | 15411 | 15430 | |
| | | | | | | 15483 | 15502 | |
| | | | | | | 15555 | 15574 | |
| | | | | | | 15613 | 15632 | |
| | | | | | | 15685 | 15704 | |
| | | | | | | 15815 | 15834 | |
| | | | | | | 15887 | 15906 | |
| | | | | | | 15945 | 15964 | |

TABLE 150-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 547747 | n/a | n/a | TCACTGTACTAGTTTC | eekd$_{10}$kke | 64 | 14746 | 14761 | 1267 |
|  |  |  |  |  |  | 14817 | 14832 |  |
|  |  |  |  |  |  | 14888 | 14903 |  |
|  |  |  |  |  |  | 14947 | 14962 |  |
|  |  |  |  |  |  | 15007 | 15022 |  |
|  |  |  |  |  |  | 15079 | 15094 |  |
|  |  |  |  |  |  | 15222 | 15237 |  |
|  |  |  |  |  |  | 15294 | 15309 |  |
|  |  |  |  |  |  | 15353 | 15368 |  |
|  |  |  |  |  |  | 15413 | 15428 |  |
|  |  |  |  |  |  | 15485 | 15500 |  |
|  |  |  |  |  |  | 15557 | 15572 |  |
|  |  |  |  |  |  | 15615 | 15630 |  |
|  |  |  |  |  |  | 15687 | 15702 |  |
|  |  |  |  |  |  | 15817 | 15832 |  |
|  |  |  |  |  |  | 15889 | 15904 |  |
|  |  |  |  |  |  | 15947 | 15962 |  |
| 548536 | n/a | n/a | TCTCAATCCCAACCCC | eekd$_{10}$kke | 0 | 22168 | 22183 | 1997 |
| 548537 | n/a | n/a | CCTCAATCCCAACCCA | eekd$_{10}$kke | 0 | 22191 | 22206 | 1998 |
| 548538 | n/a | n/a | TAGTGGCAAGAACCAC | eekd$_{10}$kke | 0 | 22627 | 22642 | 1999 |
| 548539 | n/a | n/a | CGCGCGAATGCCTGCC | eekd$_{10}$kke | 41 | 22658 | 22673 | 2000 |
| 548540 | n/a | n/a | GACACCTGCTTGATTA | eekd$_{10}$kke | 7 | 22704 | 22719 | 2001 |
| 548541 | n/a | n/a | GGCACTGGTCATGGAC | eekd$_{10}$kke | 39 | 22760 | 22775 | 2002 |
| 548542 | n/a | n/a | GCGCCATCCTTCAATC | eekd$_{10}$kke | 7 | 22857 | 22872 | 2003 |
| 548543 | n/a | n/a | GATCCACCCATGACCT | eekd$_{10}$kke | 32 | 22997 | 23012 | 2004 |
| 548544 | n/a | n/a | GCTGTGACTCAGATCA | eekd$_{10}$kke | 62 | 23070 | 23085 | 2005 |
| 548545 | n/a | n/a | CTCTTCGCATGGACAC | eekd$_{10}$kke | 46 | 23100 | 23115 | 2006 |
| 548546 | n/a | n/a | GCCCAAGCCTACATGC | eekd$_{10}$kke | 35 | 23430 | 23445 | 2007 |
| 548547 | n/a | n/a | GTGCGATTAAGCCCCA | eekd$_{10}$kke | 86 | 23514 | 23529 | 2008 |
| 548548 | n/a | n/a | GCTTGTAGAAGGGATT | eekd$_{10}$kke | 54 | 23631 | 23646 | 2009 |
| 548549 | n/a | n/a | TGTGCAATCAGGTGGA | eekd$_{10}$kke | 56 | 23765 | 23780 | 2010 |
| 548550 | n/a | n/a | CCGGCCTGGATACAGC | eekd$_{10}$kke | 0 | 23831 | 23846 | 2011 |
| 548551 | n/a | n/a | CGGCCAATGGGAAAGG | eekd$_{10}$kke | 25 | 24175 | 24190 | 2012 |
| 548552 | n/a | n/a | TGGAGGAGTAGGGAAT | eekd$_{10}$kke | 10 | 24200 | 24215 | 2013 |
| 548553 | n/a | n/a | CCCGAAGAGTCAAGTC | eekd$_{10}$kke | 46 | 24255 | 24270 | 2014 |
| 548554 | n/a | n/a | GTGCTGCATTGCATGA | eekd$_{10}$kke | 42 | 24290 | 24305 | 2015 |
| 548555 | n/a | n/a | ACACGCCAGGTGAAAA | eekd$_{10}$kke | 2 | 24322 | 24337 | 2016 |
| 548556 | n/a | n/a | ATGCATGCCTACCCAA | eekd$_{10}$kke | 43 | 24526 | 24541 | 2017 |
| 548557 | n/a | n/a | GTTACTCTGTGATCCA | eekd$_{10}$kke | 81 | 24581 | 24596 | 2018 |
| 548558 | n/a | n/a | AACATTGTGTAGCTGC | eekd$_{10}$kke | 75 | 24640 | 24655 | 2019 |
| 548559 | n/a | n/a | GAGACTGAAGCCCTCA | eekd$_{10}$kke | 44 | 24676 | 24691 | 2020 |
| 548560 | n/a | n/a | CACTGCCTAGAAAGGC | eekd$_{10}$kke | 16 | 24734 | 24749 | 2021 |
| 548561 | n/a | n/a | TGTAGTATCCAGAGTA | eekd$_{10}$kke | 46 | 24930 | 24945 | 2022 |
| 548562 | n/a | n/a | AGATGACCTGCAGATG | eekd$_{10}$kke | 50 | 24983 | 24998 | 2023 |

TABLE 150-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548563 | n/a | n/a | AAACCATGAATTAGGT | eekd$_{10}$kke | 20 | 25100 | 25115 | 2024 |
| 548564 | n/a | n/a | TTGCTACTTTACACCA | eekd$_{10}$kke | 69 | 25208 | 25223 | 2025 |
| 548565 | n/a | n/a | GGCATTAGGATAGGCA | eekd$_{10}$kke | 63 | 25350 | 25365 | 2026 |
| 548566 | n/a | n/a | CACTCAGACTGTCTGA | eekd$_{10}$kke | 0 | 25413 | 25428 | 2027 |
| 548567 | n/a | n/a | AGATCCGGAATAACCA | eekd$_{10}$kke | 67 | 25459 | 25474 | 2028 |
| 548568 | n/a | n/a | ATTGACAACCATCCTA | eekd$_{10}$kke | 27 | 25496 | 25511 | 2029 |
| 548569 | n/a | n/a | ACTCATTGGTCTACAG | eekd$_{10}$kke | 41 | 25559 | 25574 | 2030 |
| 548570 | n/a | n/a | ATGCCTTGTGCCTATT | eekd$_{10}$kke | 74 | 25706 | 25721 | 2031 |
| 548571 | n/a | n/a | ACTCTGAGGCCTTAGG | eekd$_{10}$kke | 59 | 25794 | 25809 | 2032 |
| 548572 | n/a | n/a | GCATTACTCAGCATGT | eekd$_{10}$kke | 63 | 25836 | 25851 | 2033 |
| 548573 | n/a | n/a | CCAGTCACCACCATTG | eekd$_{10}$kke | 65 | 25862 | 25877 | 2034 |
| 548574 | n/a | n/a | GGTCTAACTCTAAGGG | eekd$_{10}$kke | 0 | 25920 | 25935 | 2035 |
| 548575 | n/a | n/a | TGTCCTTTAAAGTATC | eekd$_{10}$kke | 18 | 25971 | 25986 | 2036 |
| 548576 | n/a | n/a | TCATGTGGCAACCTGT | eekd$_{10}$kke | 41 | 26114 | 26129 | 2037 |
| 548577 | n/a | n/a | AATCTGCACCTGGCAG | eekd$_{10}$kke | 42 | 26428 | 26443 | 2038 |
| 548578 | n/a | n/a | CATGGCTATTGCTTCC | eekd$_{10}$kke | 73 | 26513 | 26528 | 2039 |
| 548579 | n/a | n/a | GGGCTATATTGCCAGC | eekd$_{10}$kke | 46 | 26614 | 26629 | 2040 |
| 548580 | n/a | n/a | CCAGAGCCTTGATCAG | eekd$_{10}$kke | 36 | 26681 | 26696 | 2041 |
| 548581 | n/a | n/a | GGTGGGTTATCTGAGA | eekd$_{10}$kke | 13 | 26710 | 26725 | 2042 |
| 548582 | n/a | n/a | TAGCTCCATGCTGTGT | eekd$_{10}$kke | 59 | 26735 | 26750 | 2043 |
| 548583 | n/a | n/a | GGGAATTTATGCTGCC | eekd$_{10}$kke | 79 | 26782 | 26797 | 2044 |
| 548584 | n/a | n/a | TGATGAAGTTCCACCT | eekd$_{10}$kke | 47 | 26840 | 26855 | 2045 |
| 548585 | n/a | n/a | TAGGCACAGACAACCT | eekd$_{10}$kke | 33 | 26869 | 26884 | 2046 |
| 548586 | n/a | n/a | TCCAACTACAGGACTC | eekd$_{10}$kke | 39 | 26943 | 26958 | 2047 |
| 548587 | n/a | n/a | TTCTGGGAAACTCTCT | eekd$_{10}$kke | 45 | 26969 | 26984 | 2048 |
| 548588 | n/a | n/a | AGCTCACACCCAAAAA | eekd$_{10}$kke | 10 | 27006 | 27021 | 2049 |
| 548589 | n/a | n/a | TCTGTTACCTTGAGGA | eekd$_{10}$kke | 40 | 27280 | 27295 | 2050 |
| 548590 | n/a | n/a | TGGTCATGTCAACTGT | eekd$_{10}$kke | 35 | 27550 | 27565 | 2051 |
| 548591 | n/a | n/a | GTAAGCCTTCACAGGG | eekd$_{10}$kke | 3 | 27583 | 27598 | 2052 |
| 548592 | n/a | n/a | CTCACCAGAGTTGTCC | eekd$_{10}$kke | 7 | 27726 | 27741 | 2053 |
| 548593 | n/a | n/a | CATCCCTGACAGGTCC | eekd$_{10}$kke | 61 | 27759 | 27774 | 2054 |
| 548594 | n/a | n/a | CCCTTCTAACCAAGGA | eekd$_{10}$kke | 30 | 27825 | 27840 | 2055 |
| 548595 | n/a | n/a | GGATGAGATGCATCCA | eekd$_{10}$kke | 8 | 28069 | 28084 | 2056 |
| 548596 | n/a | n/a | ATGGCGGTGAAGCAGC | eekd$_{10}$kke | 20 | 28127 | 28142 | 2057 |
| 548597 | n/a | n/a | TGAATACCATCCCGC | eekd$_{10}$kke | 50 | 28171 | 28186 | 2058 |
| 548598 | n/a | n/a | GCGCCATCTGCCCTGT | eekd$_{10}$kke | 50 | 28253 | 28268 | 2059 |
| 548599 | n/a | n/a | TGGGTTGGAGGAGTGG | eekd$_{10}$kke | 19 | 28311 | 28326 | 2060 |

TABLE 150-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548600 | n/a | n/a | TGGTGGTGGGATTGGT | eekd$_{10}$kke | 53 | 28336 28391 28434 28446 28525 28611 28623 | 28351 28406 28449 28461 28540 28626 28638 | 2061 |
| 548601 | n/a | n/a | TTGGTGGTGGGATTGG | eekd$_{10}$kke | 18 | 28337 28392 28435 28447 28526 28612 28624 | 28352 28407 28450 28462 28541 28627 28639 | 2062 |
| 548602 | n/a | n/a | GGTGGTGGAATTGGTG | eekd$_{10}$kke | 20 | 28347 | 28362 | 2063 |
| 548603 | n/a | n/a | GAGATTGGTGGTGGGT | eekd$_{10}$kke | 35 | 28372 | 28387 | 2064 |
| 548604 | n/a | n/a | GTGGTGGGATTGGTGC | eekd$_{10}$kke | 22 | 28432 | 28447 | 2065 |
| 548605 | n/a | n/a | TGGCGGGATTGGTGGT | eekd$_{10}$kke | 12 | 28479 28558 | 28494 28573 | 2066 |
| 548606 | n/a | n/a | CGGTGGTGGGATTGGT | eekd$_{10}$kke | 41 | 28501 28580 | 28516 28595 | 2067 |
| 548607 | n/a | n/a | TCGGTGGTGGGATTGG | eekd$_{10}$kke | 34 | 28502 28581 | 28517 28596 | 2068 |
| 548608 | n/a | n/a | ATCGGTGGTGGGATTG | eekd$_{10}$kke | 25 | 28503 28582 | 28518 28597 | 2069 |
| 548609 | n/a | n/a | GATCGGTGGTGGGATT | eekd$_{10}$kke | 30 | 28504 28583 | 28519 28598 | 2070 |
| 548610 | n/a | n/a | GGATCGGTGGTGGGAT | eekd$_{10}$kke | 2 | 28505 28584 | 28520 28599 | 2071 |
| 548611 | n/a | n/a | GCGGGATCGGTGGTGG | eekd$_{10}$kke | 7 | 28508 28587 | 28523 28602 | 2072 |
| 548612 | n/a | n/a | GGCGGGATCGGTGGTG | eekd$_{10}$kke | 20 | 28509 28588 | 28524 28603 | 2073 |

TABLE 151

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTT TCCT | eeeeed$_{10}$eeeee | 46 | 14744 14815 14886 14945 15005 15077 15220 15292 15351 15411 15483 15555 15613 15685 | 14763 14834 14905 14964 15024 15096 15239 15311 15370 15430 15502 15574 15632 15704 | 334 |

TABLE 151-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15815 | 15834 | |
| | | | | | | 15887 | 15906 | |
| | | | | | | 15945 | 15964 | |
| 547747 | n/a | n/a | TCACTGTACTAGTTTC | eekd$_{10}$kke | 64 | 14746 | 14761 | 1267 |
| | | | | | | 14817 | 14832 | |
| | | | | | | 14888 | 14903 | |
| | | | | | | 14947 | 14962 | |
| | | | | | | 15007 | 15022 | |
| | | | | | | 15079 | 15094 | |
| | | | | | | 15222 | 15237 | |
| | | | | | | 15294 | 15309 | |
| | | | | | | 15353 | 15368 | |
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 548382 | n/a | n/a | GAGCAAATACAGTCCA | eekd$_{10}$kke | 19 | 12620 | 12635 | 2074 |
| 548383 | n/a | n/a | GTCTCGATGGCAAGCT | eekd$_{10}$kke | 49 | 12654 | 12669 | 2075 |
| 548384 | n/a | n/a | CTCACCGGTACTCTGC | eekd$_{10}$kke | 49 | 12805 | 12820 | 2076 |
| 548385 | n/a | n/a | TCCTGGAGGCACCAAT | eekd$_{10}$kke | 0 | 12847 | 12862 | 2077 |
| 548386 | n/a | n/a | AGCCCTGTTTGGTTTT | eekd$_{10}$kke | 0 | 12903 | 12918 | 2078 |
| 548387 | n/a | n/a | TGAAGGGCGAGGCGCA | eekd$_{10}$kke | 22 | 13261 | 13276 | 2079 |
| 548388 | n/a | n/a | AAGAGGATGTCAGGCT | eekd$_{10}$kke | 4 | 13357 | 13372 | 2080 |
| 548389 | n/a | n/a | TTGAGGAAAGACCTGC | eekd$_{10}$kke | 11 | 13399 | 13414 | 2081 |
| 548390 | n/a | n/a | GCTGAGTGTGACTTAA | eekd$_{10}$kke | 43 | 13455 | 13470 | 2082 |
| 548391 | n/a | n/a | GTACATGACTCCAGTG | eekd$_{10}$kke | 34 | 13638 | 13653 | 2083 |
| 548392 | n/a | n/a | GTAGAGCATGGAGCGA | eekd$_{10}$kke | 31 | 13730 | 13745 | 2084 |
| 548393 | n/a | n/a | CGCTTCAGGAAAGCGA | eekd$_{10}$kke | 26 | 13828 | 13843 | 2085 |
| 548394 | n/a | n/a | GGCAGGAGACTCCGTG | eekd$_{10}$kke | 25 | 13919 | 13934 | 2086 |
| 548395 | n/a | n/a | ATCCTTCCCCTCGCAA | eekd$_{10}$kke | 0 | 13966 | 13981 | 2087 |
| 548396 | n/a | n/a | TAATGAGTGGGTTAGG | eekd$_{10}$kke | 0 | 14007 | 14022 | 2088 |
| 548397 | n/a | n/a | GGAGCAGTGCAGGTAA | eekd$_{10}$kke | 1 | 14065 | 14080 | 2089 |
| 548398 | n/a | n/a | ATAGGCAATTGTTCCT | eekd$_{10}$kke | 55 | 14129 | 14144 | 2090 |
| 548399 | n/a | n/a | AGTCCTACAATTACCA | eekd$_{10}$kke | 11 | 14239 | 14254 | 2091 |
| 548400 | n/a | n/a | GGGCTCCTATTCCACC | eekd$_{10}$kke | 13 | 14277 | 14292 | 2092 |
| 548401 | n/a | n/a | GCCAGCTATGGGAACA | eekd$_{10}$kke | 71 | 14333 | 14348 | 2093 |
| 548402 | n/a | n/a | CCCCATCTCGAAGCCC | eekd$_{10}$kke | 45 | 14380 | 14395 | 2094 |
| 548403 | n/a | n/a | GAGTACATTGGGCCCA | eekd$_{10}$kke | 25 | 14418 | 14433 | 2095 |
| 548404 | n/a | n/a | GAGCCTTCCGCCTCTC | eekd$_{10}$kke | 37 | 14471 | 14486 | 2096 |
| 548405 | n/a | n/a | CGGACCTTCATCTTCA | eekd$_{10}$kke | 35 | 14529 | 14544 | 2097 |
| 548406 | n/a | n/a | TCTAGAGGCCGCCTGC | eekd$_{10}$kke | 0 | 14558 | 14573 | 2098 |
| 548407 | n/a | n/a | CCTATAACTGCTGCTC | eekd$_{10}$kke | 24 | 14731 | 14746 | 2099 |

TABLE 151-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548408 | n/a | n/a | TATCACTGTACTAGTT | eekd$_{10}$kke | 47 | 14748 | 14763 | 1269 |
| | | | | | | 14819 | 14834 | |
| | | | | | | 14890 | 14905 | |
| | | | | | | 14949 | 14964 | |
| | | | | | | 15009 | 15024 | |
| | | | | | | 15081 | 15096 | |
| | | | | | | 15153 | 15168 | |
| | | | | | | 15224 | 15239 | |
| | | | | | | 15296 | 15311 | |
| | | | | | | 15355 | 15370 | |
| | | | | | | 15415 | 15430 | |
| | | | | | | 15487 | 15502 | |
| | | | | | | 15559 | 15574 | |
| | | | | | | 15617 | 15632 | |
| | | | | | | 15689 | 15704 | |
| | | | | | | 15819 | 15834 | |
| | | | | | | 15891 | 15906 | |
| | | | | | | 15949 | 15964 | |
| 548409 | n/a | n/a | GTATCACTGTACTAGT | eekd$_{10}$kke | 81 | 14749 | 14764 | 2100 |
| | | | | | | 14820 | 14835 | |
| | | | | | | 14891 | 14906 | |
| | | | | | | 14950 | 14965 | |
| | | | | | | 15010 | 15025 | |
| | | | | | | 15082 | 15097 | |
| | | | | | | 15154 | 15169 | |
| | | | | | | 15225 | 15240 | |
| | | | | | | 15297 | 15312 | |
| | | | | | | 15356 | 15371 | |
| | | | | | | 15416 | 15431 | |
| | | | | | | 15488 | 15503 | |
| | | | | | | 15560 | 15575 | |
| | | | | | | 15618 | 15633 | |
| | | | | | | 15690 | 15705 | |
| | | | | | | 15820 | 15835 | |
| | | | | | | 15892 | 15907 | |
| | | | | | | 15950 | 15965 | |
| 548410 | n/a | n/a | AGTATCACTGTACTAG | eekd$_{10}$kke | 85 | 14750 | 14765 | 2101 |
| | | | | | | 14821 | 14836 | |
| | | | | | | 14892 | 14907 | |
| | | | | | | 14951 | 14966 | |
| | | | | | | 15011 | 15026 | |
| | | | | | | 15083 | 15098 | |
| | | | | | | 15155 | 15170 | |
| | | | | | | 15226 | 15241 | |
| | | | | | | 15298 | 15313 | |
| | | | | | | 15357 | 15372 | |
| | | | | | | 15417 | 15432 | |
| | | | | | | 15489 | 15504 | |
| | | | | | | 15561 | 15576 | |
| | | | | | | 15619 | 15634 | |
| | | | | | | 15691 | 15706 | |
| | | | | | | 15821 | 15836 | |
| | | | | | | 15893 | 15908 | |
| | | | | | | 15951 | 15966 | |
| 548411 | n/a | n/a | CAGTATCACTGTACTA | eekd$_{10}$kke | 72 | 14751 | 14766 | 2102 |
| | | | | | | 14822 | 14837 | |
| | | | | | | 14893 | 14908 | |
| | | | | | | 14952 | 14967 | |
| | | | | | | 15012 | 15027 | |
| | | | | | | 15084 | 15099 | |
| | | | | | | 15156 | 15171 | |
| | | | | | | 15227 | 15242 | |
| | | | | | | 15299 | 15314 | |
| | | | | | | 15358 | 15373 | |
| | | | | | | 15418 | 15433 | |
| | | | | | | 15490 | 15505 | |
| | | | | | | 15562 | 15577 | |
| | | | | | | 15620 | 15635 | |
| | | | | | | 15692 | 15707 | |

TABLE 151-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15822 | 15837 | |
| | | | | | | 15894 | 15909 | |
| | | | | | | 15952 | 15967 | |
| 548412 | n/a | n/a | TAACAGTATCACTGTA | eekd$_{10}$kke | 17 | 14754 | 14769 | 2103 |
| | | | | | | 14825 | 14840 | |
| | | | | | | 14896 | 14911 | |
| | | | | | | 14955 | 14970 | |
| | | | | | | 15015 | 15030 | |
| | | | | | | 15087 | 15102 | |
| | | | | | | 15159 | 15174 | |
| | | | | | | 15230 | 15245 | |
| | | | | | | 15302 | 15317 | |
| | | | | | | 15361 | 15376 | |
| | | | | | | 15421 | 15436 | |
| | | | | | | 15493 | 15508 | |
| | | | | | | 15565 | 15580 | |
| | | | | | | 15623 | 15638 | |
| | | | | | | 15695 | 15710 | |
| | | | | | | 15825 | 15840 | |
| | | | | | | 15897 | 15912 | |
| | | | | | | 15955 | 15970 | |
| 548413 | n/a | n/a | CTAACAGTATCACTGT | eekd$_{10}$kke | 55 | 14755 | 14770 | 2104 |
| | | | | | | 14826 | 14841 | |
| | | | | | | 14897 | 14912 | |
| | | | | | | 15016 | 15031 | |
| | | | | | | 15088 | 15103 | |
| | | | | | | 15231 | 15246 | |
| | | | | | | 15303 | 15318 | |
| | | | | | | 15422 | 15437 | |
| | | | | | | 15494 | 15509 | |
| | | | | | | 15624 | 15639 | |
| | | | | | | 15826 | 15841 | |
| | | | | | | 15956 | 15971 | |
| 548414 | n/a | n/a | TCTAACAGTATCACTG | eekd$_{10}$kke | 20 | 14756 | 14771 | 2105 |
| | | | | | | 14827 | 14842 | |
| | | | | | | 14898 | 14913 | |
| | | | | | | 15017 | 15032 | |
| | | | | | | 15089 | 15104 | |
| | | | | | | 15232 | 15247 | |
| | | | | | | 15304 | 15319 | |
| | | | | | | 15423 | 15438 | |
| | | | | | | 15495 | 15510 | |
| | | | | | | 15625 | 15640 | |
| | | | | | | 15827 | 15842 | |
| | | | | | | 15957 | 15972 | |
| 548415 | n/a | n/a | ATAACTCTAACAGTAT | eekd$_{10}$kke | 0 | 14761 | 14776 | 2106 |
| | | | | | | 14832 | 14847 | |
| | | | | | | 14903 | 14918 | |
| | | | | | | 15022 | 15037 | |
| | | | | | | 15094 | 15109 | |
| | | | | | | 15237 | 15252 | |
| | | | | | | 15309 | 15324 | |
| | | | | | | 15428 | 15443 | |
| | | | | | | 15500 | 15515 | |
| | | | | | | 15630 | 15645 | |
| | | | | | | 15832 | 15847 | |
| | | | | | | 15962 | 15977 | |
| 548416 | n/a | n/a | CTATAACTCTAACAGT | eekd$_{10}$kke | 9 | 14763 | 14778 | 2107 |
| | | | | | | 14834 | 14849 | |
| | | | | | | 14905 | 14920 | |
| | | | | | | 15024 | 15039 | |
| | | | | | | 15096 | 15111 | |
| | | | | | | 15239 | 15254 | |
| | | | | | | 15311 | 15326 | |
| | | | | | | 15430 | 15445 | |
| | | | | | | 15502 | 15517 | |
| | | | | | | 15632 | 15647 | |
| | | | | | | 15834 | 15849 | |

TABLE 151-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15964 | 15979 | |
| 548417 | n/a | n/a | ACTGTCCTATAACTCT | eekd$_{10}$kke | 24 | 14769<br>14840 | 14784<br>14855 | 2108 |
| 548418 | n/a | n/a | TATATCACTGTCCTAT | eekd$_{10}$kke | 39 | 14775<br>14846<br>15180<br>15716<br>16164 | 14790<br>14861<br>15195<br>15731<br>16179 | 2109 |
| 548419 | n/a | n/a | CCTATATCACTGTCCT | eekd$_{10}$kke | 52 | 14777<br>14848<br>15182<br>15718 | 14792<br>14863<br>15197<br>15733 | 2110 |
| 548420 | n/a | n/a | TCCTATATCACTGTCC | eekd$_{10}$kke | 58 | 14778<br>14849<br>15183<br>15719 | 14793<br>14864<br>15198<br>15734 | 2111 |
| 548421 | n/a | n/a | CACTGTCCTATATCAC | eekd$_{10}$kke | 56 | 14783<br>14854<br>14979<br>15117<br>15188<br>15260<br>15385<br>15523<br>15653<br>15724<br>15855<br>15985 | 14798<br>14869<br>14994<br>15132<br>15203<br>15275<br>15400<br>15538<br>15668<br>15739<br>15870<br>16000 | 2112 |
| 548422 | n/a | n/a | GTATCACTGTCCTATA | eekd$_{10}$kke | 69 | 14787<br>14983<br>15121<br>15389<br>15527<br>15989 | 14802<br>14998<br>15136<br>15404<br>15542<br>16004 | 2113 |
| 548423 | n/a | n/a | AGTATCACTGTCCTAT | eekd$_{10}$kke | 72 | 14788<br>14984<br>15050<br>15122<br>15390<br>15456<br>15528<br>15990 | 14803<br>14999<br>15065<br>15137<br>15405<br>15471<br>15543<br>16005 | 2114 |
| 548424 | n/a | n/a | CAGTATCACTGTCCTA | eekd$_{10}$kke | 90 | 14789<br>14985<br>15051<br>15123<br>15391<br>15457<br>15529<br>15991 | 14804<br>15000<br>15066<br>15138<br>15406<br>15472<br>15544<br>16006 | 2115 |
| 548425 | n/a | n/a | AACAGTATCACTGTCC | eekd$_{10}$kke | 90 | 14791<br>14987<br>15053<br>15125<br>15393<br>15459<br>15531<br>15993 | 14806<br>15002<br>15068<br>15140<br>15408<br>15474<br>15546<br>16008 | 2116 |
| 548426 | n/a | n/a | TATAACAGTATCACTG | eekd$_{10}$kke | 14 | 14794<br>14990<br>15056<br>15128<br>15161 | 14809<br>15005<br>15071<br>15143<br>15176 | 2117 |

TABLE 151-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15363 | 15378 | |
| | | | | | | 15396 | 15411 | |
| | | | | | | 15462 | 15477 | |
| | | | | | | 15534 | 15549 | |
| | | | | | | 15567 | 15582 | |
| | | | | | | 15697 | 15712 | |
| | | | | | | 15899 | 15914 | |
| | | | | | | 15996 | 16011 | |
| 548427 | n/a | n/a | CTATAACAGTATCACT | eekd$_{10}$kke | 24 | 14795 | 14810 | 2118 |
| | | | | | | 14991 | 15006 | |
| | | | | | | 15057 | 15072 | |
| | | | | | | 15129 | 15144 | |
| | | | | | | 15162 | 15177 | |
| | | | | | | 15364 | 15379 | |
| | | | | | | 15397 | 15412 | |
| | | | | | | 15463 | 15478 | |
| | | | | | | 15535 | 15550 | |
| | | | | | | 15568 | 15583 | |
| | | | | | | 15698 | 15713 | |
| | | | | | | 15900 | 15915 | |
| | | | | | | 15997 | 16012 | |
| 548428 | n/a | n/a | TAACTATAACAGTATC | eekd$_{10}$kke | 0 | 14798 | 14813 | 2119 |
| | | | | | | 15060 | 15075 | |
| | | | | | | 15132 | 15147 | |
| | | | | | | 15165 | 15180 | |
| | | | | | | 15466 | 15481 | |
| | | | | | | 15538 | 15553 | |
| | | | | | | 15571 | 15586 | |
| | | | | | | 15701 | 15716 | |
| | | | | | | 15772 | 15787 | |
| | | | | | | 16000 | 16015 | |
| 548429 | n/a | n/a | TATAACTATAACAGTA | eekd$_{10}$kke | 0 | 14800 | 14815 | 2120 |
| | | | | | | 15062 | 15077 | |
| | | | | | | 15134 | 15149 | |
| | | | | | | 15167 | 15182 | |
| | | | | | | 15468 | 15483 | |
| | | | | | | 15540 | 15555 | |
| | | | | | | 15573 | 15588 | |
| | | | | | | 15703 | 15718 | |
| | | | | | | 15774 | 15789 | |
| | | | | | | 16002 | 16017 | |
| 548430 | n/a | n/a | CCTATAACTATAACAG | eekd$_{10}$kke | 21 | 14802 | 14817 | 2121 |
| | | | | | | 15064 | 15079 | |
| | | | | | | 15169 | 15184 | |
| | | | | | | 15470 | 15485 | |
| | | | | | | 15542 | 15557 | |
| | | | | | | 15575 | 15590 | |
| | | | | | | 15705 | 15720 | |
| | | | | | | 15776 | 15791 | |
| | | | | | | 16004 | 16019 | |
| 548431 | n/a | n/a | TACCTATAACTCTAAC | eekd$_{10}$kke | 9 | 14908 | 14923 | 2122 |
| | | | | | | 15027 | 15042 | |
| | | | | | | 15099 | 15114 | |
| | | | | | | 15242 | 15257 | |
| | | | | | | 15314 | 15329 | |
| | | | | | | 15433 | 15448 | |
| | | | | | | 15505 | 15520 | |
| | | | | | | 15635 | 15650 | |
| | | | | | | 15837 | 15852 | |
| | | | | | | 15967 | 15982 | |
| 548432 | n/a | n/a | ACTGTACCTATAACTC | eekd$_{10}$kke | 43 | 14912 | 14927 | 2123 |
| | | | | | | 15031 | 15046 | |
| | | | | | | 15246 | 15261 | |
| | | | | | | 15318 | 15333 | |
| | | | | | | 15437 | 15452 | |
| | | | | | | 15509 | 15524 | |
| | | | | | | 15639 | 15654 | |

TABLE 151-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15841 | 15856 | |
| | | | | | | 15971 | 15986 | |
| 548433 | n/a | n/a | TATCACTGTACCTATA | eekd$_{10}$kke | 33 | 14916 | 14931 | 2124 |
| | | | | | | 15250 | 15265 | |
| | | | | | | 15322 | 15337 | |
| | | | | | | 15375 | 15390 | |
| | | | | | | 15513 | 15528 | |
| | | | | | | 15643 | 15658 | |
| | | | | | | 15786 | 15801 | |
| | | | | | | 15845 | 15860 | |
| | | | | | | 15975 | 15990 | |
| | | | | | | 16137 | 16152 | |
| 548434 | n/a | n/a | ACAATATCACTGTACC | eekd$_{10}$kke | 63 | 14920 | 14935 | 2125 |
| | | | | | | 15326 | 15341 | |
| | | | | | | 15790 | 15805 | |
| | | | | | | 16063 | 16078 | |
| | | | | | | 16141 | 16156 | |
| 548435 | n/a | n/a | AACAATATCACTGTAC | eekd$_{10}$kke | 19 | 14921 | 14936 | 2126 |
| | | | | | | 15327 | 15342 | |
| | | | | | | 15791 | 15806 | |
| | | | | | | 16064 | 16079 | |
| | | | | | | 16142 | 16157 | |
| 548436 | n/a | n/a | ATATCACTGTACCTGT | eekd$_{10}$kke | 8 | 14970 | 14985 | 2127 |
| 548437 | n/a | n/a | TATATCACTGTACCTG | eekd$_{10}$kke | 74 | 14971 | 14986 | 2128 |
| 548438 | n/a | n/a | CTATATCACTGTACCT | eekd$_{10}$kke | 38 | 14972 | 14987 | 2129 |
| | | | | | | 15253 | 15268 | |
| | | | | | | 15378 | 15393 | |
| | | | | | | 15516 | 15531 | |
| | | | | | | 15646 | 15661 | |
| | | | | | | 15848 | 15863 | |
| | | | | | | 15978 | 15993 | |
| 548439 | n/a | n/a | CCTATATCACTGTACC | eekd$_{10}$kke | 46 | 14973 | 14988 | 2130 |
| | | | | | | 15254 | 15269 | |
| | | | | | | 15379 | 15394 | |
| | | | | | | 15517 | 15532 | |
| | | | | | | 15647 | 15662 | |
| | | | | | | 15849 | 15864 | |
| | | | | | | 15979 | 15994 | |
| 548440 | n/a | n/a | CCTATAACAGTATCAC | eekd$_{10}$kke | 32 | 14992 | 15007 | 2131 |
| | | | | | | 15365 | 15380 | |
| | | | | | | 15398 | 15413 | |
| 548441 | n/a | n/a | TCCTATAACAGTATCA | eekd$_{10}$kke | 42 | 14993 | 15008 | 2132 |
| | | | | | | 15399 | 15414 | |
| 548442 | n/a | n/a | TTCCTATAACAGTATC | eekd$_{10}$kke | 17 | 14994 | 15009 | 2133 |
| | | | | | | 15400 | 15415 | |
| 548443 | n/a | n/a | GTTTCCTATAACAGTA | eekd$_{10}$kke | 12 | 14996 | 15011 | 2134 |
| | | | | | | 15402 | 15417 | |
| 548444 | n/a | n/a | CTATGTCACTGTACCT | eekd$_{10}$kke | 43 | 15038 | 15053 | 2135 |
| | | | | | | 15444 | 15459 | |
| 548445 | n/a | n/a | CCTATGTCACTGTACC | eekd$_{10}$kke | 62 | 15039 | 15054 | 2136 |
| | | | | | | 15445 | 15460 | |
| 548446 | n/a | n/a | TCCTATGTCACTGTAC | eekd$_{10}$kke | 16 | 15040 | 15055 | 2137 |
| | | | | | | 15446 | 15461 | |
| 548447 | n/a | n/a | CACTGTCCTATGTCAC | eekd$_{10}$kke | 59 | 15045 | 15060 | 2138 |
| | | | | | | 15451 | 15466 | |
| 548448 | n/a | n/a | TCACTGTCCTATGTCA | eekd$_{10}$kke | 61 | 15046 | 15061 | 2139 |
| | | | | | | 15452 | 15467 | |

TABLE 151-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548449 | n/a | n/a | ATCACTGTCCTATGTC | eekd$_{10}$kke | 62 | 15047 15453 | 15062 15468 | 2140 |
| 548450 | n/a | n/a | CTACCTATAACTCTAA | eekd$_{10}$kke | 0 | 15100 15171 15577 | 15115 15186 15592 | 2141 |
| 548451 | n/a | n/a | GTCCTATAACTATAAC | eekd$_{10}$kke | 0 | 15707 | 15722 | 2142 |
| 548452 | n/a | n/a | TATATCACTGTACCTA | eekd$_{10}$kke | 65 | 16006 16077 16102 16155 15252 15377 15515 15645 15847 15977 | 16021 16092 16117 16170 15267 15392 15530 15660 15862 15992 | 2143 |
| 548453 | n/a | n/a | TACCTATAACAGTATC | eekd$_{10}$kke | 12 | 15367 | 15382 | 2144 |
| 548454 | n/a | n/a | ACTGTACCTATAACAG | eekd$_{10}$kke | 17 | 15371 | 15386 | 2145 |
| 548455 | n/a | n/a | CACCGTACTAGTTTCC | eekd$_{10}$kke | 64 | 15757 | 15772 | 2146 |
| 548456 | n/a | n/a | TATAACAGTATCACCG | eekd$_{10}$kke | 52 | 15768 | 15783 | 2147 |
| 548457 | n/a | n/a | CTATAACAGTATCACC | eekd$_{10}$kke | 13 | 15769 | 15784 | 2148 |
| 548458 | n/a | n/a | ACCTATAACTATAACA | eekd$_{10}$kke | 0 | 15777 16249 | 15792 16264 | 2149 |

TABLE 152

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 531231 | n/a | n/a | TATCACTGTACTAGTT TCCT | eeeeed$_{10}$eeeee | 48 | 14744 14815 14886 14945 15005 15077 15220 15292 15351 15411 15483 15555 15613 15685 15815 15887 15945 | 14763 14834 14905 14964 15024 15096 15239 15311 15370 15430 15502 15574 15632 15704 15834 15906 15964 | 334 |
| 547747 | n/a | n/a | TCACTGTACTAGTTTC | eekd$_{10}$kke | 88 | 14746 14817 14888 14947 15007 15079 15222 15294 15353 | 14761 14832 14903 14962 15022 15094 15237 15309 15368 | 1267 |

TABLE 152-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| | | | | | | 15413 | 15428 | |
| | | | | | | 15485 | 15500 | |
| | | | | | | 15557 | 15572 | |
| | | | | | | 15615 | 15630 | |
| | | | | | | 15687 | 15702 | |
| | | | | | | 15817 | 15832 | |
| | | | | | | 15889 | 15904 | |
| | | | | | | 15947 | 15962 | |
| 548613 | n/a | n/a | TGGCGGGATCGGTGGT | eekd$_{10}$kke | 39 | 28510 | 28525 | 2150 |
| | | | | | | 28589 | 28604 | |
| 548614 | n/a | n/a | TGGTGGCGGGATCGGT | eekd$_{10}$kke | 0 | 28513 | 28528 | 2151 |
| | | | | | | 28592 | 28607 | |
| 548615 | n/a | n/a | TTGGTGGCGGGATCGG | eekd$_{10}$kke | 10 | 28514 | 28529 | 2152 |
| | | | | | | 28593 | 28608 | |
| 548616 | n/a | n/a | ATTGGTGGCGGGATCG | eekd$_{10}$kke | 35 | 28515 | 28530 | 2153 |
| 548617 | n/a | n/a | GATTGGTGGCGGGATC | eekd$_{10}$kke | 44 | 28516 | 28531 | 2154 |
| 548618 | n/a | n/a | GTTGGTGGCGGGATCG | eekd$_{10}$kke | 18 | 28594 | 28609 | 2155 |
| 548619 | n/a | n/a | GGTTGGTGGCGGGATC | eekd$_{10}$kke | 19 | 28595 | 28610 | 2156 |
| 548620 | n/a | n/a | TGGTTGGTGGCGGGAT | eekd$_{10}$kke | 24 | 28596 | 28611 | 2157 |
| 548621 | n/a | n/a | GAACACATCAGGGATT | eekd$_{10}$kke | 33 | 28638 | 28653 | 2158 |
| 548622 | n/a | n/a | TTTCTATGGGCCTGAC | eekd$_{10}$kke | 0 | 28669 | 28684 | 2159 |
| 548623 | n/a | n/a | GCTGTCACTTAAGCCA | eekd$_{10}$kke | 16 | 28862 | 28877 | 2160 |
| 548624 | n/a | n/a | TCTAGGGCCACACCTC | eekd$_{10}$kke | 24 | 28892 | 28907 | 2161 |
| 548625 | n/a | n/a | GTTCTACACACAGTAC | eekd$_{10}$kke | 0 | 29014 | 29029 | 2162 |
| 548626 | n/a | n/a | GCAGTATGTTCAATCC | eekd$_{10}$kke | 36 | 29202 | 29217 | 2163 |
| 548627 | n/a | n/a | CCCACATGTACCACCG | eekd$_{10}$kke | 22 | 29235 | 29250 | 2164 |
| 548628 | n/a | n/a | GTATGGCAGAGCCCCT | eekd$_{10}$kke | 9 | 29285 | 29300 | 2165 |
| 548629 | n/a | n/a | CCCATCTTGGGACTTT | eekd$_{10}$kke | 44 | 29341 | 29356 | 2166 |
| 548630 | n/a | n/a | TGGTCCCAAATTGGAG | eekd$_{10}$kke | 33 | 29387 | 29402 | 2167 |
| 548631 | n/a | n/a | CTCACAATACTGAGCC | eekd$_{10}$kke | 55 | 29421 | 29436 | 2168 |
| 548632 | n/a | n/a | GGAGATATCAGGTGCA | eekd$_{10}$kke | 45 | 29499 | 29514 | 2169 |
| 548633 | n/a | n/a | CAAGGCATGTGTGCAC | eekd$_{10}$kke | 41 | 29534 | 29549 | 2170 |
| 548634 | n/a | n/a | GCCTTATTCTGTGCAA | eekd$_{10}$kke | 0 | 29583 | 29598 | 2171 |
| 548635 | n/a | n/a | AGGTGTGGCGCGCGCC | eekd$_{10}$kke | 18 | 29853 | 29868 | 2172 |
| 548636 | n/a | n/a | CTCTATACAGCTGGGC | eekd$_{10}$kke | 5 | 30000 | 30015 | 2173 |
| 548637 | n/a | n/a | GCTGATCTTCTAATGC | eekd$_{10}$kke | 38 | 30063 | 30078 | 2174 |
| 548638 | n/a | n/a | CCTCATTGCTCCACTA | eekd$_{10}$kke | 26 | 30103 | 30118 | 2175 |
| 548639 | n/a | n/a | TGGGAAGAAACTAGCA | eekd$_{10}$kke | 10 | 30159 | 30174 | 2176 |
| 548640 | n/a | n/a | GAATGTTGCTGTCCCA | eekd$_{10}$kke | 32 | 30194 | 30209 | 2177 |
| 548641 | n/a | n/a | GCATCATGCTTACTGC | eekd$_{10}$kke | 23 | 30225 | 30240 | 2178 |
| 548642 | n/a | n/a | GCGGCAGTAGTGAATC | eekd$_{10}$kke | 23 | 30288 | 30303 | 2179 |
| 548643 | n/a | n/a | CCTACCTAATTCCTCC | eekd$_{10}$kke | 0 | 30329 | 30344 | 2180 |

TABLE 152-continued

| ISIS NO | SEQ ID NO: 1 Start Site | SEQ ID NO: 1 Stop Site | Sequence | Chemistry | % inhibition | SEQ ID NO: 10 Start Site | SEQ ID NO: 10 Stop Site | SEQ ID NO |
|---|---|---|---|---|---|---|---|---|
| 548644 | n/a | n/a | AACTGGGCAGTCCTTC | eekd$_{10}$kke | 14 | 30418 | 30433 | 2181 |
| 548645 | n/a | n/a | CCAGCGCAATTCTGCT | eekd$_{10}$kke | 8 | 30666 | 30681 | 2182 |
| 548646 | n/a | n/a | CGTTTCCCTCAACTCC | eekd$_{10}$kke | 24 | 30750 | 30765 | 2183 |
| 548647 | n/a | n/a | CACGGCAAGTCGCGGG | eekd$_{10}$kke | 39 | 30790 | 30805 | 2184 |
| 548648 | n/a | n/a | CAGTTGTATCCCTCCC | eekd$_{10}$kke | 32 | 30852 | 30867 | 2185 |
| 548649 | n/a | n/a | GCCTCTCAGACGGCAC | eekd$_{10}$kke | 0 | 30906 | 30921 | 2186 |
| 548650 | n/a | n/a | CTGATCCCACTTGCCC | eekd$_{10}$kke | 21 | 30991 | 31006 | 2187 |
| 548651 | n/a | n/a | AGTCTCTTTCCTACCC | eekd$_{10}$kke | 61 | 31030 | 31045 | 2188 |
| 548652 | n/a | n/a | CCACGATGCTCTGGCC | eekd$_{10}$kke | 65 | 31068 | 31083 | 2189 |
| 548653 | n/a | n/a | TCGGCTCCTGGCAGCA | eekd$_{10}$kke | 46 | 31111 | 31126 | 2190 |
| 548654 | n/a | n/a | ACCATTCCTGACCATG | eekd$_{10}$kke | 34 | 31151 | 31166 | 2191 |
| 548655 | n/a | n/a | CCCGAGGTCACATAAT | eekd$_{10}$kke | 56 | 31416 | 31431 | 2192 |
| 548656 | n/a | n/a | TTACAACAGACCCAGG | eekd$_{10}$kke | 35 | 31497 | 31512 | 2193 |
| 548657 | n/a | n/a | AGCAGGGTATCTTCAC | eekd$_{10}$kke | 26 | 31548 | 31563 | 2194 |
| 548658 | n/a | n/a | GAAGTTCCTGTGTCTT | eekd$_{10}$kke | 11 | 31593 | 31608 | 2195 |
| 548659 | n/a | n/a | CCAACCTCTAAGGCTA | eekd$_{10}$kke | 17 | 31721 | 31736 | 2196 |
| 548660 | n/a | n/a | ATGCTTACCTTTCTCC | eekd$_{10}$kke | 0 | 31955 | 31970 | 2197 |
| 548661 | n/a | n/a | ACGACCCACTCCATGT | eekd$_{10}$kke | 18 | 32016 | 32031 | 2198 |
| 548662 | n/a | n/a | TGCTTAAAAGTCTCCC | eekd$_{10}$kke | 5 | 32155 | 32170 | 2199 |
| 548663 | n/a | n/a | GCCCTAGAAGGGCCCA | eekd$_{10}$kke | 20 | 32219 | 32234 | 2200 |
| 548664 | n/a | n/a | GCGGGTGGTCTTGCAC | eekd$_{10}$kke | 38 | 32245 | 32260 | 2201 |
| 548665 | n/a | n/a | GCTCCCGGCCATTAGC | eekd$_{10}$kke | 8 | 32312 | 32327 | 2202 |
| 548666 | n/a | n/a | TCTCCATAGTGAGACG | eekd$_{10}$kke | 1 | 32342 | 32357 | 2203 |
| 548667 | n/a | n/a | TGGCAAGCTACCTTCT | eekd$_{10}$kke | 51 | 32384 | 32399 | 2204 |
| 548668 | n/a | n/a | GGGAGCTTTCATGGCT | eekd$_{10}$kke | 68 | 32506 | 32521 | 2205 |
| 548669 | n/a | n/a | AATGCAGGCCAGCATC | eekd$_{10}$kke | 42 | 32541 | 32556 | 2206 |
| 548670 | n/a | n/a | GAAAGCCCTCCGAGC | eekd$_{10}$kke | 15 | 32590 | 32605 | 2207 |
| 548671 | n/a | n/a | CAACAATCCAAAGCCT | eekd$_{10}$kke | 3 | 32674 | 32689 | 2208 |
| 548672 | n/a | n/a | CCCCCCAGAAATCCCA | eekd$_{10}$kke | 40 | 32708 | 32723 | 2209 |
| 548673 | n/a | n/a | GACCTTGCTTCCATGT | eekd$_{10}$kke | 40 | 32753 | 32768 | 2210 |
| 548674 | n/a | n/a | GAGAGACGGCACCCTG | eekd$_{10}$kke | 4 | 32829 | 32844 | 2211 |
| 548675 | n/a | n/a | GGGAAGGTAGTGTTAC | eekd$_{10}$kke | 8 | 32898 | 32913 | 2212 |
| 548676 | n/a | n/a | GTGAATCAGAGCAGTG | eekd$_{10}$kke | 63 | 32963 | 32978 | 2213 |
| 548677 | n/a | n/a | TCACCTGTGAGTAACC | eekd$_{10}$kke | 40 | 33089 | 33104 | 2214 |
| 548678 | n/a | n/a | GAGTTACCTTACAAGC | eekd$_{10}$kke | 22 | 33232 | 33247 | 2215 |
| 548679 | n/a | n/a | TCTCAAGCAGCCTATT | eekd$_{10}$kke | 0 | 33267 | 33282 | 2216 |

TABLE 152-continued

| ISIS NO | SEQ ID NO: 1 Start Site | SEQ ID NO: 1 Stop Site | Sequence | Chemistry | % inhi-bition | SEQ ID NO: 10 Start Site | SEQ ID NO: 10 Stop Site | SEQ ID NO |
|---|---|---|---|---|---|---|---|---|
| 548680 | n/a | n/a | GCCCCTCTTAAATAGC | eekd₁₀kke | 9 | 33446 | 33461 | 2217 |
| 548681 | n/a | n/a | GATATCATCATCCCAA | eekd₁₀kke | 22 | 33513 | 33528 | 2218 |
| 548682 | n/a | n/a | GTATCCCCTTTTCTAT | eekd₁₀kke | 0 | 33556 | 33571 | 2219 |
| 548683 | n/a | n/a | AGTATCTCATGTGCCT | eekd₁₀kke | 46 | 33581 | 33596 | 2220 |
| 548684 | n/a | n/a | CAAGACCTTGCTTGCC | eekd₁₀kke | 24 | 33658 | 33673 | 2221 |
| 548685 | n/a | n/a | TAGTCCACTACACAGC | eekd₁₀kke | 24 | 33802 | 33817 | 2222 |
| 548686 | n/a | n/a | ACGACAATGGGATTCA | eekd₁₀kke | 0 | 33844 | 33859 | 2223 |
| 548687 | n/a | n/a | GAATCTCCCTGAGTCA | eekd₁₀kke | 20 | 33888 | 33903 | 2224 |
| 548688 | n/a | n/a | TAGAGGGATCCCAGGA | eekd₁₀kke | 0 | 34416 | 34431 | 2225 |
| 548689 | n/a | n/a | CCAGGTGCAGCACGGA | eekd₁₀kke | 12 | 34483 | 34498 | 2226 |

Example 117

Dose-dependent Antisense Inhibition of Human PKK in HepaRG™ Cells

Gapmers from the studies described above exhibiting significant in vitro inhibition of PKK mRNA were selected and tested at various doses in HepaRG™ cells. Cells were plated at a density of 20,000 cells per well and transfected using electroporation with 0.12 µM, 0.37 µM, 1.11 µM, 3.33 µM, and 10.00 µM concentrations of antisense oligonucleotide. After a treatment period of approximately 16 hours, RNA was isolated from the cells and PKK mRNA levels were measured by quantitative real-time PCR. Human PKK primer probe set RTS3454 was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells.

The half maximal inhibitory concentration (IC$_{50}$) of each oligonucleotide is also presented. PKK mRNA levels were significantly reduced in a dose-dependent manner in antisense oligonucleotide treated cells.

TABLE 153

| ISIS No | 0.12 µM | 0.37 µM | 1.11 µM | 3.33 µM | 10.00 µM | IC$_{50}$ (µM) |
|---|---|---|---|---|---|---|
| 486847 | 0 | 34 | 48 | 71 | 87 | 1.1 |
| 530933 | 15 | 13 | 42 | 67 | 66 | 1.7 |
| 530959 | 12 | 27 | 53 | 80 | 94 | 0.9 |
| 530965 | 8 | 5 | 63 | 83 | 91 | 0.8 |
| 530967 | 30 | 36 | 48 | 82 | 91 | 0.7 |
| 530970 | 1 | 0 | 66 | 76 | 84 | 1.0 |
| 530971 | 12 | 40 | 52 | 66 | 70 | 1.3 |
| 530988 | 0 | 25 | 54 | 86 | 78 | 0.9 |
| 530992 | 0 | 50 | 63 | 83 | 80 | 0.7 |
| 531002 | 6 | 28 | 58 | 82 | 86 | 0.9 |
| 531004 | 0 | 14 | 25 | 71 | 84 | 2.1 |
| 531005 | 14 | 28 | 61 | 73 | 77 | 0.9 |
| 531022 | 0 | 0 | 32 | 62 | 77 | 2.2 |
| 531078 | 10 | 27 | 54 | 69 | 92 | 1.1 |
| 531231 | 23 | 30 | 76 | 89 | 94 | 0.6 |

TABLE 154

| ISIS No | 0.12 µM | 0.37 µM | 1.11 µM | 3.33 µM | 10.00 µM | IC$_{50}$ (µM) |
|---|---|---|---|---|---|---|
| 531026 | 23 | 26 | 49 | 75 | 85 | 1.0 |
| 531055 | 3 | 28 | 64 | 76 | 81 | 0.9 |
| 531069 | 19 | 39 | 48 | 76 | 83 | 0.9 |
| 531071 | 23 | 37 | 56 | 83 | 83 | 0.7 |
| 531110 | 14 | 29 | 49 | 76 | 85 | 1.1 |
| 531121 | 0 | 13 | 47 | 69 | 79 | 1.5 |
| 531123 | 14 | 43 | 51 | 71 | 64 | 0.9 |
| 531172 | 0 | 16 | 37 | 60 | 60 | 2.1 |
| 531198 | 0 | 35 | 62 | 76 | 60 | 0.8 |
| 531231 | 18 | 0 | 36 | 76 | 84 | 2.0 |
| 531232 | 15 | 26 | 40 | 62 | 76 | 1.7 |
| 531233 | 17 | 27 | 50 | 77 | 84 | 1.0 |
| 531234 | 24 | 21 | 47 | 72 | 82 | 1.4 |
| 531235 | 27 | 55 | 62 | 84 | 95 | 0.4 |
| 531236 | 4 | 28 | 59 | 85 | 93 | 0.8 |

Example 118

Dose-dependent Antisense Inhibition of Human PKK in HepaRG™ Cells

Gapmers from the studies described above exhibiting significant in vitro inhibition of PKK mRNA were selected and tested at various doses in HepaRG™ cells. Cells were plated at a density of 20,000 cells per well and transfected using electroporation with 0.19 µM, 0.56 µM, 1.67 µM, and 5.00 µM concentrations of antisense oligonucleotide. After a treatment period of approximately 16 hours, RNA was isolated from the cells and PKK mRNA levels were measured by quantitative real-time PCR. Human PKK primer probe set RTS3454 was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells. 'n/a' indicates that there was no measurement done for that particular antisense oligonucleotide for that particular dose.

The half maximal inhibitory concentration ($IC_{50}$) of each oligonucleotide is also presented. PKK mRNA levels were significantly reduced in a dose-dependent manner in antisense oligonucleotide treated cells.

TABLE 155

| ISIS No | 0.19 µM | 0.56 µM | 1.67 µM | 5.00 µM | $IC_{50}$ (µM) |
|---|---|---|---|---|---|
| 531231 | 32 | 30 | 73 | 89 | 0.5 |
| 546158 | 5 | 45 | 79 | 83 | 0.7 |
| 546188 | 36 | 55 | 81 | 83 | 0.4 |
| 546253 | 1 | 13 | 46 | 81 | 1.7 |
| 546254 | 51 | 66 | 80 | 91 | 0.2 |
| 546343 | 28 | 64 | 87 | 87 | 0.4 |
| 546825 | 46 | 73 | 86 | 88 | 0.2 |
| 546827 | 32 | 70 | 84 | 90 | 0.3 |
| 546828 | 39 | 58 | 87 | 93 | 0.3 |
| 546829 | 3 | 30 | 73 | 88 | 1.0 |
| 546846 | 36 | 45 | 71 | 82 | 0.5 |
| 547413 | 0 | 0 | 41 | 83 | 2.2 |
| 547423 | 37 | 50 | 92 | 90 | 0.4 |
| 547445 | 41 | 75 | 82 | 88 | 0.2 |
| 547456 | 12 | 67 | 66 | 80 | 1.0 |
| 547464 | 21 | 52 | 67 | 97 | 0.6 |
| 547564 | 51 | 48 | 82 | 90 | 0.2 |
| 547587 | 20 | 62 | 84 | 86 | 0.5 |
| 548758 | 41 | 47 | 82 | 94 | 0.4 |

TABLE 156

| ISIS No | 0.19 µM | 0.56 µM | 1.67 µM | 5.00 µM | $IC_{50}$ (µM) |
|---|---|---|---|---|---|
| 531231 | 25 | 34 | 84 | 92 | 0.7 |
| 546190 | 33 | 65 | 86 | n/a | 0.4 |
| 546208 | 16 | 45 | 79 | 91 | 0.7 |
| 546216 | 62 | 69 | 88 | 88 | 0.1 |
| 546255 | 32 | 35 | 78 | 87 | 0.5 |
| 546268 | 56 | 50 | 82 | 93 | 0.1 |
| 546301 | 25 | 50 | 53 | 87 | 0.8 |
| 546849 | 23 | 35 | 83 | 91 | 0.7 |
| 546852 | 19 | 40 | 78 | 85 | 0.8 |
| 546889 | 23 | 54 | 78 | 91 | 0.6 |
| 546916 | 43 | 71 | 79 | 89 | 0.2 |
| 546967 | 20 | 39 | 76 | 71 | 0.7 |
| 547273 | 44 | 69 | 87 | 87 | 0.2 |
| 547276 | 35 | 44 | 71 | 77 | 0.6 |
| 547335 | 8 | 52 | 85 | 92 | 0.7 |
| 547340 | 46 | 79 | 88 | n/a | 0.2 |
| 547602 | 18 | 53 | 92 | 87 | 0.5 |
| 547647 | 1 | 70 | 72 | n/a | 0.8 |
| 547694 | 0 | 29 | 67 | 90 | 1.2 |

TABLE 157

| ISIS No | 0.19 µM | 0.56 µM | 1.67 µM | 5.00 µM | $IC_{50}$ (µM) |
|---|---|---|---|---|---|
| 531231 | 58 | 64 | 77 | 98 | 0.1 |
| 546247 | 0 | 29 | 71 | 88 | 1.1 |
| 546251 | 31 | 60 | 99 | 89 | 0.5 |
| 546753 | 28 | 47 | 83 | 96 | 0.5 |

TABLE 157-continued

| ISIS No | 0.19 µM | 0.56 µM | 1.67 µM | 5.00 µM | $IC_{50}$ (µM) |
|---|---|---|---|---|---|
| 546826 | 17 | 40 | 87 | 97 | 0.7 |
| 546833 | 8 | 33 | 74 | 94 | 0.9 |
| 546854 | 23 | 39 | 83 | 94 | 0.6 |
| 546894 | 15 | 47 | 50 | 93 | 0.9 |
| 546897 | 40 | 56 | 71 | 95 | 0.4 |
| 546903 | 15 | 37 | 74 | 98 | 0.8 |
| 546986 | 31 | 49 | 77 | 89 | 0.5 |
| 547293 | 53 | 57 | 80 | 86 | 0.2 |
| 547298 | 32 | 61 | 74 | 90 | 0.4 |
| 547364 | 38 | 47 | 54 | 89 | 0.6 |
| 547373 | 20 | 7 | 49 | 86 | 1.1 |
| 547426 | 19 | 50 | 84 | 93 | 0.6 |
| 547454 | 19 | 40 | 58 | 92 | 0.9 |
| 547617 | 52 | 66 | 77 | 93 | 0.2 |
| 548770 | 26 | 54 | 77 | 91 | 0.5 |

TABLE 158

| ISIS No | 0.19 µM | 0.56 µM | 1.67 µM | 5.00 µM | $IC_{50}$ (µM) |
|---|---|---|---|---|---|
| 531231 | 34 | 47 | 72 | n/a | 0.5 |
| 546214 | 0 | 0 | 68 | 85 | 1.3 |
| 546304 | 0 | 6 | 51 | 71 | 2.1 |
| 546739 | 35 | 55 | 57 | 79 | 0.6 |
| 546832 | 19 | 38 | 70 | 95 | 0.8 |
| 546847 | 39 | 57 | 75 | 89 | 0.4 |
| 546855 | 18 | 7 | 30 | 82 | 2.2 |
| 546877 | 0 | 19 | 75 | 80 | 1.3 |
| 546939 | 1 | 66 | 86 | 90 | 0.6 |
| 547349 | 0 | 8 | 66 | 76 | 1.6 |
| 547360 | 8 | 27 | 76 | 76 | 0.8 |
| 547368 | 0 | 0 | 31 | 80 | 2.5 |
| 547483 | 0 | 9 | 49 | 71 | 2.1 |
| 547575 | 0 | 34 | 82 | 93 | 1.1 |
| 547618 | 0 | 0 | 73 | 98 | 1.3 |
| 547622 | 0 | 47 | 79 | 90 | 0.9 |
| 547637 | 10 | 21 | 36 | 82 | 1.8 |
| 547731 | 0 | 0 | 17 | 56 | 5.0 |
| 548752 | 0 | 0 | 51 | 90 | 1.9 |

TABLE 159

| ISIS No | 0.19 µM | 0.56 µM | 1.67 µM | 5.00 µM | $IC_{50}$ (µM) |
|---|---|---|---|---|---|
| 531231 | 21 | 45 | 67 | 96 | 0.7 |
| 546195 | 34 | 51 | 79 | 92 | 0.5 |
| 546198 | 7 | 3 | 45 | 92 | 1.3 |
| 546287 | 0 | 15 | 39 | 89 | 1.7 |
| 546358 | 0 | 19 | 71 | 80 | 1.3 |
| 546403 | 0 | 20 | 37 | 41 | >5.0 |
| 546410 | 13 | 43 | 52 | 75 | 1.2 |
| 546412 | 0 | 1 | 61 | 62 | 2.3 |
| 546429 | 6 | 10 | 44 | 69 | 2.3 |
| 546834 | 1 | 0 | 30 | 83 | 2.3 |
| 547006 | 0 | 0 | 54 | 77 | 1.5 |
| 547294 | 28 | 59 | 87 | 86 | 0.4 |
| 547337 | 23 | 41 | 55 | 79 | 1.0 |
| 547514 | 18 | 8 | 51 | 80 | 1.9 |
| 547584 | 26 | 34 | 76 | 86 | 0.7 |
| 547585 | 42 | 57 | 70 | 95 | 0.4 |
| 547615 | 20 | 26 | 41 | 84 | 1.4 |
| 547636 | 0 | 24 | 79 | 94 | 1.1 |
| 548744 | 14 | 35 | 63 | 83 | 1.0 |

TABLE 160

| ISIS No | 0.19 µM | 0.56 µM | 1.67 µM | 5.00 µM | IC$_{50}$ (µM) |
|---|---|---|---|---|---|
| 531231 | 21 | 39 | 90 | 97 | 0.6 |
| 546232 | 49 | 50 | 94 | 97 | 0.2 |
| 546248 | 25 | 66 | 87 | 93 | 0.4 |
| 546835 | 9 | 35 | 68 | 93 | 0.9 |
| 546848 | 0 | 18 | 91 | 97 | 1.0 |
| 546853 | 47 | 64 | 84 | n/a | 0.2 |
| 546870 | 35 | 42 | 80 | 95 | 0.5 |
| 546872 | 32 | 33 | 82 | 94 | 0.4 |
| 546876 | 0 | 50 | 85 | 95 | 0.8 |
| 547275 | 34 | 66 | 82 | 95 | 0.3 |
| 547341 | 36 | 58 | 91 | 95 | 0.3 |
| 547366 | 0 | 45 | 68 | 91 | 1.2 |
| 547453 | 25 | 40 | 54 | 92 | 0.8 |
| 547457 | 41 | 65 | 80 | 85 | 0.3 |
| 547616 | 26 | 50 | 72 | 89 | 0.6 |
| 547632 | 44 | 47 | 81 | 97 | 0.6 |
| 547633 | 12 | 46 | 78 | n/a | 0.7 |
| 547718 | 36 | 12 | 69 | 74 | 1.6 |
| 548757 | 18 | 49 | 82 | 93 | 0.6 |

TABLE 161

| ISIS No | 0.19 µM | 0.56 µM | 1.67 µM | 5.00 µM | IC$_{50}$ (µM) |
|---|---|---|---|---|---|
| 531231 | 6 | 38 | 74 | 95 | 0.8 |
| 546291 | 22 | 32 | 34 | 72 | 2.0 |
| 546310 | 0 | 36 | 56 | 80 | 1.3 |
| 546896 | 0 | 45 | 82 | 97 | 0.8 |
| 546980 | 0 | 18 | 29 | 80 | 2.2 |
| 547009 | 0 | 9 | 21 | 63 | 3.6 |
| 547019 | 0 | 6 | 54 | 86 | 1.6 |
| 547277 | 2 | 32 | 34 | 62 | 2.8 |
| 547288 | 0 | 0 | 0 | 38 | >5.0 |
| 547374 | 0 | 15 | 24 | 44 | >5.0 |
| 547493 | 0 | 26 | 64 | 77 | 1.3 |
| 547520 | 0 | 25 | 66 | 64 | 1.1 |
| 547712 | 0 | 5 | 21 | 62 | 3.8 |
| 547722 | 0 | 15 | 32 | 73 | 2.4 |
| 547728 | 0 | 2 | 16 | 61 | 4.4 |
| 547780 | 0 | 10 | 36 | 55 | 3.9 |
| 548743 | 25 | 57 | 73 | 88 | 0.5 |
| 548753 | 0 | 23 | 49 | 84 | 1.5 |
| 548756 | 0 | 4 | 16 | 86 | >5.0 |

TABLE 162

| ISIS No | 0.19 µM | 0.56 µM | 1.67 µM | 5.00 µM | IC$_{50}$ (µM) |
|---|---|---|---|---|---|
| 531231 | 25 | 55 | 89 | 97 | 0.5 |
| 546188 | 27 | 69 | 88 | 97 | 0.4 |
| 546216 | 23 | 78 | 95 | 98 | <0.2 |
| 546254 | 40 | 63 | 84 | 95 | 0.3 |
| 546268 | 0 | 71 | 92 | 92 | 0.5 |
| 546343 | 37 | 32 | 83 | 95 | 0.4 |
| 546825 | 38 | 82 | n/a | 99 | 0.2 |
| 546827 | 23 | 74 | 98 | 96 | 0.4 |
| 546828 | 0 | 64 | 89 | 97 | 0.2 |
| 546846 | 26 | 49 | 85 | n/a | 0.5 |
| 546967 | 22 | 45 | 74 | 92 | 0.7 |
| 547273 | 0 | 60 | 82 | 83 | 0.6 |
| 547340 | 34 | 84 | 96 | n/a | 0.3 |
| 547423 | 78 | 92 | n/a | n/a | <0.2 |
| 547445 | 80 | 87 | 98 | 91 | <0.2 |
| 547564 | 46 | 66 | 90 | 97 | 0.2 |
| 547587 | 38 | 64 | 91 | 97 | 0.3 |
| 547602 | 1 | 9 | 52 | 93 | 1.4 |
| 548758 | 0 | 72 | 79 | n/a | 0.6 |

TABLE 163

| ISIS No | 0.19 µM | 0.56 µM | 1.67 µM | 5.00 µM | IC$_{50}$ (µM) |
|---|---|---|---|---|---|
| 531231 | 7 | 39 | 56 | 97 | 1.0 |
| 546190 | 21 | 34 | 76 | 98 | 0.7 |
| 546208 | 5 | 33 | 70 | 97 | 0.9 |
| 546251 | 19 | 45 | 91 | 97 | 0.6 |
| 546255 | 5 | 39 | 82 | 96 | 0.8 |
| 546739 | 4 | 62 | 84 | 86 | 0.6 |
| 546753 | 17 | 31 | 70 | 91 | 0.9 |
| 546849 | 13 | 45 | 84 | 98 | 0.7 |
| 546889 | 25 | 9 | 73 | 92 | 1.4 |
| 546897 | 16 | 17 | 69 | 97 | 0.8 |
| 546916 | 0 | 27 | 73 | 97 | 1.0 |
| 546986 | 7 | 28 | 69 | 86 | 1.1 |
| 547276 | 6 | 3 | 53 | 68 | 2.2 |
| 547293 | 0 | 45 | 65 | 70 | 1.3 |
| 547298 | 0 | 12 | 67 | 87 | 1.7 |
| 547335 | 0 | 13 | 73 | 95 | 1.3 |
| 547426 | 18 | 35 | 80 | 95 | 0.7 |
| 547617 | 17 | 37 | 79 | 98 | 0.7 |
| 548770 | 9 | 0 | 61 | 92 | 1.7 |

TABLE 164

| ISIS No | 0.19 µM | 0.56 µM | 1.67 µM | 5.00 µM | IC$_{50}$ (µM) |
|---|---|---|---|---|---|
| 531231 | 6 | 56 | 68 | 97 | 0.8 |
| 546195 | 0 | 27 | 91 | 94 | 0.9 |
| 546232 | 0 | 74 | 95 | 96 | 0.2 |
| 546248 | 0 | 59 | 73 | 89 | 0.8 |
| 546832 | 36 | 49 | 85 | 97 | 0.4 |
| 546847 | 14 | 44 | 83 | 95 | 0.7 |
| 546853 | 4 | 49 | 74 | 92 | 0.8 |
| 546870 | 36 | 34 | 61 | 91 | 1.0 |
| 546872 | 42 | 13 | 59 | 99 | 1.4 |
| 546896 | 35 | 60 | 83 | n/a | 0.4 |
| 546939 | 16 | 71 | 96 | 95 | 0.4 |
| 547275 | 56 | 16 | 80 | 86 | 1.2 |
| 547294 | 4 | 70 | 84 | 91 | 0.6 |
| 547341 | 45 | 44 | 81 | 95 | 0.6 |
| 547457 | 33 | 42 | 70 | 83 | 0.6 |
| 547584 | 0 | 21 | 64 | 92 | 1.3 |
| 547585 | 0 | 46 | 89 | 93 | 0.8 |
| 547632 | 0 | 0 | 63 | 91 | 1.6 |
| 548743 | 22 | 47 | 74 | 96 | 0.6 |

Example 119

Dose-dependent Antisense Inhibition of Human PKK in HepaRG™ Cells

Gapmers from the studies described above exhibiting significant in vitro inhibition of PKK mRNA were selected and tested at various doses in HepaRG™ cells. Cells were plated at a density of 20,000 cells per well and transfected using electroporation with 0.11 µM, 0.33 µM, 1.00 µM, and 3.00 µM concentrations of antisense oligonucleotide. After a treatment period of approximately 16 hours, RNA was isolated from the cells and PKK mRNA levels were measured by quantitative real-time PCR. Human PKK primer probe set RTS3454 was used to measure mRNA levels. PKK mRNA levels were adjusted according to total RNA content, as measured by RIBOGREEN®. The antisense oligonucleotides were tested in a series of experiments that had similar culture conditions. The results for each experiment are presented in separate tables shown below. Results are presented as percent inhibition of PKK, relative to untreated control cells. 'n/a' indicates that there was no measurement done for that particular antisense oligonucleotide for that particular dose.

The half maximal inhibitory concentration (IC$_{50}$) of each oligonucleotide is also presented. PKK mRNA levels were significantly reduced in a dose-dependent manner in antisense oligonucleotide treated cells.

TABLE 165

| ISIS No | 0.11 µM | 0.33 µM | 1.00 µM | 3.00 µM | IC$_{50}$ (µM) |
|---|---|---|---|---|---|
| 547747 | 24 | 29 | 81 | 89 | 0.4 |
| 547769 | 12 | 17 | 80 | 96 | 0.6 |
| 547824 | 45 | 73 | 78 | n/a | 0.1 |
| 547835 | 44 | 27 | 53 | 79 | 0.9 |
| 547843 | 0 | 52 | 80 | 91 | 0.4 |
| 547857 | 36 | 66 | 77 | 93 | 0.2 |
| 547870 | 0 | 44 | 80 | 97 | 0.6 |
| 547943 | 33 | 70 | 87 | 90 | 0.2 |
| 547946 | 0 | 47 | 74 | n/a | 0.5 |
| 547947 | 24 | 58 | 81 | 93 | 0.3 |
| 547998 | 55 | 73 | 91 | 91 | 0.1 |
| 548004 | 24 | 47 | 80 | 92 | 0.3 |
| 548010 | 0 | 11 | 49 | 64 | 1.4 |
| 548047 | 50 | 62 | 76 | 95 | 0.1 |
| 548147 | 59 | 94 | 80 | n/a | 0.0 |
| 548338 | 41 | 58 | 79 | 95 | 0.2 |
| 548348 | 19 | 46 | 67 | 91 | 0.4 |
| 548409 | 21 | 60 | 90 | 93 | 0.3 |
| 548557 | 5 | 47 | 82 | 95 | 0.4 |

TABLE 166

| ISIS No | 0.11 µM | 0.33 µM | 1.00 µM | 3.00 µM | IC$_{50}$ (µM) |
|---|---|---|---|---|---|
| 547747 | 8 | 61 | 90 | 92 | 0.3 |
| 547807 | 26 | 71 | 61 | 94 | 0.4 |
| 547922 | 67 | 75 | 81 | 92 | 0.0 |
| 547927 | 56 | 64 | 92 | 88 | 0.1 |
| 547948 | 60 | 80 | 88 | 97 | 0.0 |
| 547979 | 56 | 58 | 94 | 97 | 0.1 |
| 548005 | 53 | 49 | 71 | 95 | 0.4 |
| 548024 | 28 | 57 | 84 | 82 | 0.3 |
| 548043 | 14 | 60 | 90 | 92 | 0.3 |
| 548055 | 43 | 57 | 50 | 88 | 0.3 |
| 548106 | 53 | 54 | 82 | 94 | 0.1 |
| 548109 | 50 | 92 | 79 | 85 | 0.1 |
| 548155 | 49 | 50 | 70 | 81 | 0.3 |
| 548180 | 11 | 59 | 71 | 88 | 0.4 |
| 548278 | 3 | 59 | 78 | 93 | 0.4 |
| 548343 | 61 | 67 | 88 | 92 | 0.0 |
| 548558 | 53 | 61 | 78 | 95 | 0.1 |
| 548570 | 20 | 40 | 70 | 94 | 0.4 |
| 548583 | 43 | 46 | 93 | 88 | 0.2 |

TABLE 167

| ISIS No | 0.11 µM | 0.33 µM | 1.00 µM | 3.00 µM | IC$_{50}$ (µM) |
|---|---|---|---|---|---|
| 547747 | 3 | 44 | 72 | 90 | 0.5 |
| 547849 | 36 | 52 | 67 | n/a | 0.3 |
| 547851 | 16 | 46 | 83 | n/a | 0.4 |
| 547859 | 29 | 56 | 83 | 78 | 0.3 |
| 547862 | 26 | 71 | 69 | n/a | 0.3 |
| 547877 | 29 | 66 | 83 | n/a | 0.2 |
| 547942 | 25 | 51 | 91 | n/a | 0.3 |
| 547997 | 39 | 68 | n/a | 82 | 0.2 |
| 548046 | 7 | 35 | 64 | 77 | 0.7 |
| 548048 | 49 | 66 | 86 | 92 | 0.1 |
| 548061 | 26 | 61 | 59 | n/a | 0.4 |
| 548070 | 26 | 35 | 48 | 63 | 1.1 |
| 548125 | 33 | 50 | 81 | 73 | 0.3 |
| 548195 | 5 | 23 | 61 | 76 | 0.8 |
| 548265 | 47 | 69 | 78 | 67 | 0.1 |
| 548410 | 31 | 58 | 85 | 82 | 0.2 |

TABLE 167-continued

| ISIS No | 0.11 µM | 0.33 µM | 1.00 µM | 3.00 µM | IC$_{50}$ (µM) |
|---|---|---|---|---|---|
| 548424 | 17 | 67 | 86 | 72 | 0.3 |
| 548425 | 41 | 57 | 68 | 80 | 0.2 |
| 548547 | 30 | 41 | 76 | 90 | 0.4 |

TABLE 168

| ISIS No | 0.11 µM | 0.33 µM | 1.00 µM | 3.00 µM | IC$_{50}$ (µM) |
|---|---|---|---|---|---|
| 547747 | 16 | 59 | 85 | 96 | 0.3 |
| 547808 | 19 | 22 | 48 | 71 | 1.1 |
| 547861 | 7 | 40 | 75 | 84 | 0.5 |
| 548069 | 6 | 0 | 27 | 66 | 1.9 |
| 548128 | 14 | 29 | 49 | 66 | 1.1 |
| 548170 | 0 | 8 | 26 | 65 | 2.0 |
| 548174 | 20 | 18 | 29 | 62 | 2.0 |
| 548197 | 33 | 37 | 51 | 75 | 0.8 |
| 548201 | 0 | 7 | 70 | 85 | 0.8 |
| 548217 | 22 | 24 | 54 | 71 | 0.9 |
| 548220 | 0 | 0 | 0 | 6 | >3 |
| 548247 | 16 | 50 | 62 | 82 | 0.5 |
| 548422 | 0 | 32 | 71 | 93 | 0.7 |
| 548479 | 2 | 52 | 82 | 97 | 0.4 |
| 548486 | 20 | 48 | 77 | 92 | 0.4 |
| 548521 | 21 | 0 | 3 | 1 | >3 |
| 548655 | 0 | 0 | 8 | 33 | >3 |
| 548667 | 0 | 37 | 73 | 86 | 0.7 |
| 548668 | 10 | 30 | 61 | 84 | 0.7 |

Example 120

Efficacy of Antisense Oligonucleotides Targeting Human PKK in Transgenic Mice

Transgenic mice containing a 37,390 base pair fragment of the human KLKB1 gene sequence (chromosome 4: position 187148672-187179625, accession no: NC_000004.11) were treated with ISIS antisense oligonucleotides selected from studies described above, which were evaluated for efficacy in this model.

Treatment

Groups of transgenic mice were injected subcutaneously twice a week for 3 weeks with 2.5 mg/kg/week, 5.0 mg/kg/week, 10 mg/kg/week or 20 mg/kg/week of ISIS 546232, ISIS 546251, ISIS 546254, ISIS 546343, ISIS 546828, ISIS 547455, ISIS 547457, ISIS 547927, and ISIS 548048. One group of transgenic mice was injected subcutaneously twice a week for 3 weeks with PBS. Mice were euthanized 48 hours after the last dose, and organs and plasma were harvested for further analysis.

RNA Analysis

To evaluate the effect of ISIS oligonucleotides on target reduction, RNA was extracted from liver tissue for real-time PCR analysis of human PKK. Results are presented as percent inhibition of PKK mRNA, relative to PBS control. As shown in Table 169, treatment with ISIS antisense oligonucleotides resulted in significant reduction of PKK mRNA in comparison to the PBS control.

TABLE 169

Percent Inhibition of PKK mRNA in the transgenic mice liver relative to the PBS control

| ISIS No | Dose | % inhibition |
|---|---|---|
| 547927 | 20 | 71 |
|  | 10 | 93 |
|  | 5 | 52 |
|  | 2.5 | 35 |
| 547455 | 20 | 62 |
|  | 10 | 45 |
|  | 5 | 69 |
|  | 2.5 | 0 |
| 546232 | 20 | 84 |
|  | 10 | 30 |
|  | 5 | 53 |
|  | 2.5 | 57 |
| 546254 | 20 | 83 |
|  | 10 | 84 |
|  | 5 | 55 |
|  | 2.5 | 31 |
| 546343 | 20 | 86 |
|  | 10 | 66 |
|  | 5 | n/a |
|  | 2.5 | 46 |
| 548048 | 20 | 80 |
|  | 10 | 72 |
|  | 5 | 77 |
|  | 2.5 | 7 |
| 546828 | 20 | 83 |
|  | 10 | 32 |
|  | 5 | 62 |
|  | 2.5 | 77 |
| 546251 | 20 | 79 |
|  | 10 | 66 |
|  | 5 | 51 |
|  | 2.5 | 13 |
| 547457 | 20 | 62 |
|  | 10 | 45 |
|  | 5 | 69 |
|  | 2.5 | 0 |

Protein Analysis

Plasma PKK protein levels were evaluated in all groups. Results are presented as percent inhibition of PKK protein, relative to PBS control. As shown in Table 170, treatment with ISIS antisense oligonucleotides resulted in significant reduction of PKK protein levels in comparison to the PBS control.

TABLE 170

Percent reduction of PKK protein levels in the transgenic mice relative to the PBS control

| ISIS No | Dose | % inhibition |
|---|---|---|
| 547927 | 20 | 80 |
|  | 10 | n/a |
|  | 5 | 21 |
|  | 2.5 | 25 |
| 547455 | 20 | 78 |
|  | 10 | 32 |
|  | 5 | 0 |
|  | 2.5 | 0 |
| 546232 | 20 | 79 |
|  | 10 | 33 |
|  | 5 | 6 |
|  | 2.5 | 0 |
| 546254 | 20 | 76 |
|  | 10 | 51 |
|  | 5 | 36 |
|  | 2.5 | 0 |
| 546343 | 20 | 79 |
|  | 10 | 38 |
|  | 5 | n/a |
|  | 2.5 | 0 |
| 548048 | 20 | 98 |
|  | 10 | 89 |
|  | 5 | 70 |
|  | 2.5 | 23 |
| 546828 | 20 | 93 |
|  | 10 | 36 |
|  | 5 | 25 |
|  | 2.5 | 0 |
| 546251 | 20 | 69 |
|  | 10 | 52 |
|  | 5 | 30 |
|  | 2.5 | 22 |
| 547457 | 20 | 60 |
|  | 10 | 31 |
|  | 5 | 4 |
|  | 2.5 | 0 |

Example 121

Effect of ISIS Antisense Oligonucleotides Targeting Human PKK in Cynomolgus Monkeys Cynomolgus monkeys were treated with ISIS antisense oligonucleotides selected from studies described above. Antisense oligonucleotide efficacy and tolerability were evaluated. The human antisense oligonucleotides tested are cross-reactive with the rhesus genomic sequence (GENBANK Accession No. NW_001118167.1 truncated from nucleotides 2358000 to 2391000 and designated herein as SEQ ID NO: 18). The target start site of each oligonucleotide to SEQ ID NO: 18 is presented in Table 171. 'Mismatches' indicates that the number of nucleotides by which the oligonucleotide is mismatched to the rhesus sequence. The greater the complementarity between the human oligonucleotide and the rhesus monkey sequence, the more likely the human oligonucleotide can cross-react with the rhesus monkey sequence. 'n/a' indicates that the oligonucleotide is has more than 3 mismatches with the rhesus gene sequence.

TABLE 171

Antisense oligonucleotides complementary to SEQ ID NO: 18

| ISIS No | Target Start Site | Mismatches | Sequence | Chemistry | SEQ ID NO. |
|---|---|---|---|---|---|
| 547927 | 22059 | 1 | ATGGTCCGACACACAA | Deoxy, MOE and cEt | 1548 |
| 546232 | n/a | n/a | AGGAACTTGGTGTGCCACTT | 5-10-5 MOE | 526 |
| 547455 | 27391 | 0 | ATATCATGATTCCCTTCTGA | 5-10-5 MOE | 657 |
| 546254 | 23858 | 1 | TGCAAGTCTCTTGGCAAACA | 5-10-5 MOE | 570 |
| 546343 | 30532 | 0 | CCCCCTTCTTTATAGCCAGC | 5-10-5 MOE | 705 |

TABLE 171-continued

Antisense oligonucleotides
complementary to SEQ ID NO: 18

| ISIS No | Target Start Site | Mis-matches | Sequence | Chemistry | SEQ ID NO. |
|---|---|---|---|---|---|
| 548048 | 27397 | 0 | CGATATCATG ATTCCC | Deoxy, MOE and cEt | 1666 |
| 546828 | 13632 | 1 | ACAGTATCAC TGTACTAGTT | 5-10-5 MOE | 904 |
| 546251 | 23846 | 0 | GGCAAACATT CACTCCTTTA | 5-10-5 MOE | 566 |
| 547457 | 27397 | 0 | AAGGCGATAT CATGATTCCC | 5-10-5 MOE | 660 |

Treatment

Prior to the study, the monkeys were kept in quarantine for a 30-day period, during which the animals were observed daily for general health. The monkeys were 2-4 years old and weighed between 2 and 4 kg. Ten groups of four randomly assigned male cynomolgus monkeys each were injected subcutaneously with ISIS oligonucleotide or PBS. PBS solution or ISIS oligonucleotides at a dose of 40 mg/kg were administered initially with a loading regimen consisting of four doses on the first week of the study (days 1, 3, 5, and 7), followed by a maintenance regimen consisting of once weekly administration starting on Day 14 (weeks 2 to 13). Subcutaneous injections were performed in clock-wise rotations at 4 sites on the back; one site per dose. The injection sites were delineated by tattoo, while sedated using ketamine, and were separated by a minimum of 3 cm.

During the study period, the monkeys were observed a minimum of once daily for signs of illness or distress. Any animal experiencing more than momentary or slight pain or distress due to the treatment, injury or illness was promptly reported to the responsible veterinarian and the Study Director. Any animal in poor health or in a possible moribund condition was identified for further monitoring and possible euthanasia. For example, two monkeys treated with ISIS 547445 were euthanized due to subdued behavior, lateral position, lack of response to stimuli and decreased respiration. The protocols described in the Example were approved by the Institutional Animal Care and Use Committee (IACUC).

Target Reduction
RNA Analysis

On day 87 or 88, 48 hours after the final dose, RNA was extracted from liver tissue for real-time PCR analysis of PKK using primer probe set RTS3455 (forward sequence CCTGTGTGGAGGGTCACTCA, designated herein as SEQ ID NO: 23; reverse sequence CCACTATAGATGCGCCAAACATC, designated herein as SEQ ID NO: 24; probe sequence CCCACTGCTTTGATGGGCTTCCC, designated herein as SEQ ID NO: 25). The results were normalized to the housekeeping gene, Cyclophilin. Results are presented as percent inhibition of PKK mRNA, relative to PBS control. As shown in Table 172, treatment with ISIS antisense oligonucleotides resulted in significant reduction of PKK mRNA in comparison to the PBS control.

TABLE 172

Percent Inhibition of PKK mRNA
in the cynomolgus monkey liver relative to the PBS control

| ISIS No | % inhibition |
|---|---|
| 546232 | 88 |
| 546251 | 90 |
| 546254 | 88 |
| 546343 | 74 |
| 546828 | 45 |
| 547455 | 90 |
| 547457 | 89 |
| 547927 | 54 |
| 548048 | 95 |

Protein Analysis

Approximately 0.9 mL of blood was collected each time from all available animals at pre-dose, day 17, day 31, day 45, day 59, and day 73, and placed in tubes containing 3.2% sodium citrate. The tubes were centrifuged (3000 rpm for 10 min at room temperature) to obtain plasma. PKK protein levels were measured in the plasma by ELISA. The results are presented in Table 173, expressed as percentage inhibition compared to the PBS control levels. The results indicate that ISIS oligonucleotides significantly reduced PKK protein levels.

TABLE 173

PKK protein level reduction (%) in the cynomolgus monkey plasma relative to control levels

| | Day 17 | Day 31 | Day 45 | Day 59 | Day 73 |
|---|---|---|---|---|---|
| ISIS 546232 | 53 | 58 | 72 | 75 | 70 |
| ISIS 546251 | 71 | 75 | 75 | 81 | 77 |
| ISIS 546254 | 38 | 51 | 63 | 74 | 73 |
| ISIS 546343 | 56 | 74 | 69 | 70 | 70 |
| ISIS 546828 | 0 | 8 | 23 | 39 | 39 |
| ISIS 547455 | 26 | 33 | 43 | 58 | 58 |
| ISIS 547457 | 68 | 75 | 79 | 76 | 80 |
| ISIS 547927 | 8 | 0 | 15 | 10 | 18 |
| ISIS 548048 | 90 | 93 | 95 | 95 | 95 |

Tolerability Studies
Liver Function

To evaluate the effect of ISIS oligonucleotides on hepatic function, the monkeys were fasted overnight. Approximately, 1.5 mL of blood samples were collected from all the study groups. Blood was collected in tubes without anticoagulant for serum separation. The tubes were kept at room temperature for a minimum of 90 min and then centrifuged at 3,000 rpm for 10 min. Levels of various liver function markers were measured using a Toshiba 120FR NEO chemistry analyzer (Toshiba Co., Japan). The results are presented in Table 174 and indicate that antisense oligonucleotides had no effect on liver function outside the expected range for antisense oligonucleotides.

TABLE 174

Liver function markers in cynomolgus monkey plasma

| | Albumin (g/dL) | AST (IU/L) | ALT (IU/L) |
|---|---|---|---|
| PBS | 4.2 | 48 | 60 |
| ISIS 546232 | 4.1 | 63 | 140 |
| ISIS 546251 | 3.7 | 51 | 58 |
| ISIS 546254 | 3.8 | 68 | 54 |

TABLE 174-continued

Liver function markers in cynomolgus monkey plasma

|  | Albumin (g/dL) | AST (IU/L) | ALT (IU/L) |
|---|---|---|---|
| ISIS 546343 | 4.3 | 49 | 76 |
| ISIS 546828 | 3.7 | 75 | 67 |
| ISIS 547455 | 3.8 | 56 | 61 |
| ISIS 547457 | 4.0 | 54 | 52 |
| ISIS 547927 | 4.2 | 59 | 61 |
| ISIS 548048 | 4.2 | 44 | 47 |

Hematology

To evaluate any effect of ISIS oligonucleotides in cynomolgus monkeys on hematologic parameters, blood samples of approximately 1.2 mL of blood was collected pre-dose and on day 87 or day 88 from each of the available study animals in tubes containing $K_2$-EDTA. Samples were analyzed for red blood cell (RBC) count, white blood cells (WBC) count, platelet count, hemoglobin content and hematocrit, using an ADVIA2120i hematology analyzer (SIEMENS, USA). The data is presented in Table 175.

The data indicate treatment with most of the oligonucleotides did not cause any changes in hematologic parameters outside the expected range for antisense oligonucleotides at this dose.

TABLE 175

Hematological parameters in cynomolgus monkeys

|  | RBC ($\times 10^6/\mu L$) | Platelets ($\times 10^3/\mu L$) | WBC ($\times 10^3/\mu L$) | Hemoglobin (g/dL) | HCT (%) |
|---|---|---|---|---|---|
| PBS | 5.4 | 458 | 13 | 13.1 | 43 |
| ISIS 546232 | 5.4 | 391 | 11 | 12.9 | 42 |
| ISIS 546251 | 5.7 | 419 | 8 | 12.9 | 43 |
| ISIS 546254 | 5.3 | 436 | 11 | 12.4 | 41 |
| ISIS 546343 | 5.5 | 373 | 14 | 12.6 | 42 |
| ISIS 546828 | 6.0 | 408 | 11 | 12.9 | 43 |
| ISIS 547455 | 4.5 | 448 | 13 | 10.2 | 34 |
| ISIS 547457 | 6.4 | 367 | 10 | 13.8 | 45 |
| ISIS 547927 | 5.2 | 461 | 45 | 12.5 | 41 |
| ISIS 548048 | 5.9 | 393 | 11 | 13.4 | 44 |

Kidney Function

To evaluate the effect of ISIS oligonucleotides on kidney function, the monkeys were fasted overnight. Approximately, 1.5 mL of blood samples were collected from all the study groups. Blood was collected in tubes without anticoagulant for serum separation. The tubes were kept at room temperature for a minimum of 90 min and then centrifuged at 3,000 rpm for 10 min. Levels of BUN and creatinine were measured using a Toshiba 120FR NEO chemistry analyzer (Toshiba Co., Japan). Results are presented in Table 176, expressed in mg/dL. The plasma chemistry data indicate that most of the ISIS oligonucleotides did not have any effect on the kidney function outside the expected range for antisense oligonucleotides. Specifically, treatment with ISIS 546254 was well tolerated in terms of the kidney function of the monkeys.

Kidney function was also assessed by urinalysis. Fresh urine from all animals was collected using a clean cage pan on wet ice. Food was removed overnight the day before fresh urine collection was done but water was supplied. The total protein and creatinine levels were measured using a Toshiba 120FR NEO automated chemistry analyzer (Toshiba Co., Japan) and the protein to creatinine ratio was calculated. The results are presented in Table 177.

TABLE 176

Plasma BUN and creatinine levels (mg/dL) in cynomolgus monkeys

|  | BUN | Creatinine |
|---|---|---|
| PBS | 22.8 | 0.9 |
| ISIS 546232 | 22.7 | 1.0 |
| ISIS 546251 | 25.4 | 1.1 |
| ISIS 546254 | 25.7 | 0.9 |
| ISIS 546343 | 26.2 | 1.0 |
| ISIS 546828 | 24.7 | 0.9 |
| ISIS 547455 | 29.4 | 0.9 |
| ISIS 547457 | 24.3 | 1.0 |
| ISIS 547927 | 22.3 | 1.0 |
| ISIS 548048 | 21.9 | 0.9 |

TABLE 177

Urine protein/creatinine ratio in cynomolgus monkeys

|  | Ratio |
|---|---|
| ISIS 546232 | 0.03 |
| ISIS 546251 | 0.12 |
| ISIS 546254 | 0.04 |
| ISIS 546343 | 0.01 |
| ISIS 546828 | 0.03 |
| ISIS 547455 | 0.70 |
| ISIS 547457 | 0.03 |
| ISIS 547927 | 0.04 |
| ISIS 548048 | 0.03 |
| PBS | 0.06 |

C-reactive Protein Level Analysis

To evaluate any inflammatory effect of ISIS oligonucleotides in cynomolgus monkeys, the monkeys were fasted overnight. Approximately, 1.5 mL of blood samples were collected from all the study groups. Blood was collected in tubes without anticoagulant for serum separation. The tubes were kept at room temperature for a minimum of 90 min and then centrifuged at 3,000 rpm for 10 min. C-reactive protein (CRP), which is synthesized in the liver and which serves as a marker of inflammation, was measured using a Toshiba 120FR NEO chemistry analyzer (Toshiba Co., Japan). Complement C3 was also measured similarly, and the data is presented as a percentage of baseline values. The results are presented in Table 178 and indicate that treatment with ISIS oligonucleotides did not cause any inflammation in monkeys.

TABLE 178

C-reactive protein and C3 levels in cynomolgus monkey plasma

|  | CRP (mg/dL) | C3 (% of baseline) |
|---|---|---|
| PBS | 0.2 | 73 |
| ISIS 546232 | 0.5 | 50 |
| ISIS 546251 | 0.7 | 62 |
| ISIS 546254 | 0.8 | 61 |
| ISIS 546343 | 0.2 | 60 |
| ISIS 546828 | 0.6 | 56 |
| ISIS 547455 | 1.9 | 64 |
| ISIS 547457 | 0.3 | 53 |
| ISIS 547927 | 0.2 | 73 |
| ISIS 548048 | 0.2 | 69 |

Example 122

Antisense Inhibition of Murine PKK mRNA in Mouse Primary Hepatocytes

Antisense oligonucleotides targeting a murine PKK nucleic acid were designed and tested for their effects on PKK mRNA in vitro. Cultured mouse primary hepatocytes at a density of 10,000 cells per well were transfected using Cytofectin reagent with 12.5 nM, 25.0 nM, 50.0 nM, 100.0 nM, and 200.0 nM of antisense oligonucleotide. After a treatment period of approximately 24 hours, RNA was isolated from the cells and mouse PKK mRNA levels were measured by quantitative real-time PCR using the murine primer probe set RTS3313 (forward sequence TGCCTGCTGTTCAGCTTTCTC, designated herein as SEQ ID NO: 2228; reverse sequence TGGCAAAGTCCCTGTAATGCT, designated herein as SEQ ID NO: 2229; probe sequence CGTGACTCCACCCAAAGAGACAAATAAACG, designated herein as SEQ ID NO: 2230). PKK mRNA levels were adjusted according to total RNA content, as measured by RIBOGREEN.

The chimeric antisense oligonucleotides were designed as 5-10-5 MOE gapmers. The gapmers are 20 nucleotides in length, wherein the central gap segment is comprised of ten 2'-deoxynucleosides and is flanked on both sides (in the 5' and 3' directions) by wings comprising 5 nucleosides each. Each nucleoside in the 5' wing segment and each nucleoside in the 3' wing segment has a 2'-O-methoxyethyl modification. The internucleoside linkages throughout each gapmer are phosphorothioate linkages. All cytosine residues throughout each gapmer are 5-methylcytosines. Results demonstrate that PKK mRNA levels were significantly reduced in a dose dependent manner.

In one specific example, ISIS 482584 (GGCATATTGGTTTTTGGAAT; SEQ ID NO: 2244) reduced PKK mRNA in a dose dependent manner yielding a half maximal inhibitory concentration ($IC_{50}$) of 84 nM (see Table 179). ISIS 482584 is targeted to SEQ ID NO: 11 (GENBANK Accession No. NM_008455.2) and has a target start site of 1586 and a target stop site of 1605. "Target start site" indicates the 5'-most nucleotide to which the gapmer is targeted. "Target stop site" indicates the 3'-most nucleotide to which the gapmer is targeted.

TABLE 179

Dose-dependent inhibition of mouse PKK mRNA levels by ISIS 482584

| Dose | % inhibition |
| --- | --- |
| 12.5 nM | 0 |
| 25.0 nM | 47 |
| 50.0 nM | 27 |
| 100.0 nM | 60 |
| 200.0 nM | 82 |

Example 123

Antisense Inhibition of PKK mRNA in BALB/c Mice

ISIS 482584 was tested for its effect on murine PKK mRNA in vivo.

Treatment

Six groups of male BALB/c mice each were treated with 2.5 mg/kg, 5.0 mg/kg, 10.0 mg/kg, 20.0 mg/kg, 40.0 mg/kg, or 80.0 mg/kg of ISIS 482584, administered subcutaneously twice a week for 3 weeks (weekly doses of 5.0 mg/kg, 10.0 mg/kg, 20.0 mg/kg, 40.0 mg/kg, 80.0 mg/kg, or 160.0 mg/kg). A control group of BALB/c mice was treated with PBS, administered subcutaneously twice a week for 3 weeks. Two days after the last dose of antisense oligonucleotide or PBS, mice from all groups were anesthetized with 150 mg/kg ketamine mixed with 10 mg/kg xylazine, administered by intraperitoneal injection. Liver was collected for RNA analysis.

RNA Analysis

RNA was extracted from liver tissue for real-time PCR analysis of PKK. PKK mRNA levels were measured using the murine primer probe set (forward sequence ACAAGTGCATTTTACAGACCAGAGTAC, designated herein as SEQ ID NO: 2231; reverse sequence GGTTGTCCGCTGACTTTATGCT, designated herein as SEQ ID NO: 2232; probe sequence AAGCACAGTGCAAGCGGAACACCC, designated herein as SEQ ID NO: 2233). Results are presented as percent inhibition of PKK, relative to PBS control. As shown in Table 180, treatment with ISIS 482584 resulted in significant dose-dependent reduction of PKK mRNA in comparison to the PBS control.

TABLE 180

Dose-dependent reduction of PKK mRNA in BALB/c mice liver

| Dose (mg/kg/wk) | % inhibition |
| --- | --- |
| 5 | 3 |
| 10 | 42 |
| 20 | 68 |
| 40 | 85 |
| 80 | 91 |
| 160 | 94 |

Protein Analysis

Plasma was collected in tubes containing sodium citrate as an anticoagulant. The samples were run on a 4-12% gradient SDS-polyacrylamide gel (Invitrogen), followed by immunoblotting with murine PKK antibody (R&D Systems). Blots were incubated with secondary fluorophore-labeled antibodies (LI-COR) and imaged in an Odyssey Imager (LI-COR). Results are presented as percent inhibition of PKK, relative to PBS control. As shown in Table 181, treatment with ISIS 482584 resulted in significant dose-dependent reduction of PKK plasma protein in comparison to the PBS control.

TABLE 181

Dose-dependent reduction of PKK protein in BALB/c mice plasma

| Dose (mg/kg/wk) | % inhibition |
| --- | --- |
| 5 | 5 |
| 10 | 24 |
| 20 | 47 |
| 40 | 76 |
| 80 | 81 |
| 160 | n.d. | n.d. = no data

Example 124

In Vivo Effect of Antisense Inhibition of Murine PKK in an Angioedema Mouse Model Hereditary angioedema (HAE) is characterized by local swelling and increase in vascular permeability in subcutaneous tissues (Morgan, B. P. N. Engl. J. Med. 363: 581-83, 2010). It is caused by a deficiency of the C1 inhibitor, a protein of the complement system. Two mouse models were used in this study including an established mouse model of C1-INH deficiency and a captopril-induced edema model, both of which cause vascular permeability, a hallmark of HAE. Reversal of vascular permeability is accompanied by increased plasma levels of high molecular weight kininogen (HMWK).

In the first model, angioedema was induced by treatment with Captopril, a known antihypertensive agent, which increases vascular permeability in mice and replicates the pathology of hereditary angioedema.

In the second model, angioedema was induced by treatment with ISIS 461756, an antisense oligonucleotide which targets murine C1 inhibitor mRNA, which increases vascular permeability in mice and replicates the pathology of hereditary angioedema. ISIS 461756 (SEQ ID NO: 2245; AAAGTGGTTGATACCCTGGG) is a 5-10-5 MOE gapmer targeting nucleosides 1730-1749 of NM_009776.3 (SEQ ID NO: 2243).

The effect of HOE-140 and ISIS 482584, an antisense oligonucleotide inhibitor of PKK, were evaluated in the Captopril and ISIS 461756-induced mouse models of vascular permeability. Some of the murine groups were treated with HOE-140, a selective antagonist of the bradykinin B2 receptor, which blocks vasodilation and vascular permeability (Cruden and Newby, Expert Opin. Pharmacol. 9: 2383-90, 2008). Other mice were treated with ISIS 482584, which inhibits PKK mRNA expression. The effect of treatment with HOE-140 was compared with the effect of treatment with ISIS 482584.

Treatment

The various treatment groups for this assay are presented in Table 182.

Group 1 consisted of 4 C57BL/6J-Tyrc-2J mice treated with PBS administered subcutaneously twice a week for 4 weeks. No other treatment was administered to Group 1 which served as a control group to measure the basal level of vascular permeability.

Group 2 consisted of 8 C57BL/6J-Tyrc-2J mice treated with PBS administered subcutaneously twice a week for 4 weeks. At the end of the treatment, the mice were intraperitoneally administered 20 µg of captopril. Group 2 served as a PBS control group for captopril-induced vascular permeability.

Group 3 consisted of 8 C57BL/6J-Tyrc-2J mice treated with PBS administered subcutaneously twice a week for 4 weeks. On day 14, the mice were treated with 50 mg/kg of the antisense oligonucleotide targeting C1 inhibitor, ISIS 461756, administered subcutaneously twice a week for 2 weeks. At the end of the treatment period, the mice were intraperitoneally administered 20 µg of captopril. Group 3 served as a PBS control group for captopril and ISIS 461756-induced vascular permeability.

Group 4 consisted of 8 C57BL/6J-Tyrc-2J mice treated with PBS administered subcutaneously twice a week for 4 weeks. On day 14, the mice were treated with 50 mg/kg of the antisense oligonucleotide targeting C1 inhibitor, ISIS 461756, administered subcutaneously twice a week for 2 weeks. At the end of the treatment period, the mice were intraperitoneally administered 20 µg of captopril. The mice were then also intraperitoneally administered 30 µg of HOE-140. Group 4 served as a positive control for inhibition of vascular permeability with HOE-140.

Group 5 consisted of 8 C57BL/6J-Tyrc-2J mice treated with 40 mg/kg of control oligonucleotide ISIS 141923, a 5-10-5 MOE gapmer with no known murine target, (CCTTCCCTGAAGGTTCCTCC; SEQ ID NO: 2246) administered subcutaneously twice a week for 4 weeks. On day 14, the mice were treated with 50 mg/kg of the antisense oligonucleotide targeting C1 inhibitor, ISIS 461756, administered subcutaneously twice a week for 2 weeks. At the end of the treatment period, the mice were intraperitoneally administered 20 µg of captopril. Group 5 served as a control group for captopril and ISIS 461756-induced vascular permeability.

Group 6 consisted of 8 C57BL/6J-Tyrc-2J mice and was treated with 40 mg/kg of ISIS 482584 administered subcutaneously twice a week for 4 weeks. At the end of the treatment period, the mice were intraperitoneally administered 20 µg of captopril. Group 6 served as the experimental treatment group for examining the effect of PKK ASO on captopril-induced vascular permeability.

Group 7 consisted of 8 C57BL/6J-Tyrc-2J mice treated with 40 mg/kg of ISIS 482584 administered subcutaneously twice a week for 4 weeks. On day 14, the mice were treated with 50 mg/kg of the antisense oligonucleotide targeting C1 inhibitor, ISIS 461756, administered subcutaneously twice a week for 2 weeks. At the end of the treatment period, the mice were intraperitoneally administered 20 µg of captopril. Group 7 served as the experimental treatment group for examining the effect of PKK ASO on captopril and ISIS 461756-induced vascular permeability.

All the groups were then injected with 30 mg/kg of Evans Blue solution into the tail vein. The mice were sacrificed 30 min after the Evans Blue solution administration and colons, feet, ears, and intestines were harvested. Blood samples were taken through cardiac puncture.

TABLE 182

Treatment groups

| Group No. | Treatment | Captopril | ISIS 461756 | HOE-140 |
|---|---|---|---|---|
| 1. (N = 4) | PBS | No | No | No |
| 2. (N = 8) | PBS | Yes | No | No |
| 3. (N = 8) | PBS | Yes | Yes | No |
| 4. (N = 8) | PBS | Yes | Yes | Yes |
| 5. (N = 8) | ISIS 141923 | Yes | Yes | No |
| 6. (N = 8) | ISIS 482584 | Yes | No | No |
| 7. (N = 8) | ISIS 482584 | Yes | Yes | No |

Quantification of Vascular Permeability

The harvested tissues from the feet, colon, ears, and intestines were placed separately in formamide solution overnight to leach out the Evans Blue dye. The formamide solution containing ear and feet tissue was heated to 55° C. and left overnight. The color intensity of the dye-infused formamide solution was then measured at $OD_{600nm}$, and is presented in Table 183. Mice displaying any manifestation of angioedema take up more dye and, therefore, demonstrate high OD values.

As presented in Table 183, treatment with ISIS 482584 prevents vascular permeability in mice treated with captopril (Group 6) and in mice treated with captopril and ISIS 461756 (Group 7) compared to the respective PBS control groups (Groups 2 and 3). Measures of vascular permeability in mice of Groups 6 and 7 were also reduced in most of the tissues in comparison to the mice treated with the control oligonucleotide, ISIS 141923 (Group 5), where vascular permeability was induced with captopril and ISIS 461756. Measures of vascular permeability in the colon and feet tissues of both the treatment groups (Groups 6 and 7) were comparable to basal levels, as observed in mice treated with only PBS (Group 1). Reduction in vascular permeability in mice treated with ISIS 482584 was comparable to that seen in mice treated with the bradykinin 2 receptor antagonist, HOE140, which served as a positive control in this assay.

Therefore, antisense inhibition of PKK mRNA may be beneficial for the treatment and prevention of vascular permeability, which is symptomatic of HAE.

TABLE 183

$OD_{600\,nm}$ of Evans Blue dye to measure vascular permeability

| Group No. | Treatment | Captopril | ISIS 461756 | HOE-140 | Colons | Intestines | Feet | Ears |
|---|---|---|---|---|---|---|---|---|
| 1 | PBS | No | No | No | 0.26 | 0.16 | 0.11 | 0.02 |
| 2 | PBS | Yes | No | No | 0.49 | 0.29 | 0.12 | 0.07 |
| 3 | PBS | Yes | Yes | No | 0.49 | 0.34 | 0.11 | 0.12 |
| 4 | PBS | Yes | Yes | Yes | 0.14 | 0.18 | 0.07 | 0.09 |
| 5 | ISIS 141923 | Yes | Yes | No | 0.44 | 0.29 | 0.14 | 0.08 |
| 6 | ISIS 482584 | Yes | No | No | 0.27 | 0.30 | 0.07 | 0.14 |
| 7 | ISIS 482584 | Yes | Yes | No | 0.21 | 0.34 | 0.07 | 0.06 |

Quantification of High Molecular Weight Kininogen (HMWK)

Western blot quantification of HMWK from blood samples shows that Groups 1 and 2 have low levels of HMWK as compared to Groups 6 and 7 indicating that vascular permeability is reversed in Groups 6 and 7. Samples from Groups 1 and 2 have increased HMWK cleavage product as compared to Groups 6 and 7. Thus, lack of HMWK is caused by PKK cleavage of HMWK into cleavage products (including bradykinin and HKa).

Example 125

In Vivo Effect of Antisense Inhibition of Murine PKK on Basal Permeability and Captopril-induced Permeability in Mice Basal permeability is the level of vascular permeability occurring in the tissues of naïve, untreated mice. The effect of ISIS 482584 in the prevention of vascular permeability, either basal or captopril-induced, was evaluated.

Treatment

The various treatment groups for this assay are presented in Table 184.

Group 1 consisted of 8 mice and was treated with PBS administered subcutaneously twice a week for 4 weeks. No other treatment was administered to Group 1 which served as a control group to measure the basal levels of vascular permeability.

Group 2 consisted of 8 mice and was treated with PBS administered subcutaneously twice a week for 4 weeks. At the end of the treatment period, the mice were intraperitoneally administered 20 μg of captopril. Group 2 served as the negative control group for captopril-induced vascular permeability.

Group 3 consisted of 8 mice and was treated with PBS administered subcutaneously twice a week for 4 weeks. At the end of the treatment period, the mice were intraperitoneally administered 30 μg of HOE-140. Group 3 served as a positive control for inhibition of basal vascular permeability.

Group 4 consisted of 8 mice and was treated with PBS administered subcutaneously twice a week for 4 weeks. At the end of the treatment period, the mice were intraperitoneally administered 20 μg of captopril. The mice were also intraperitoneally administered 30 μg of HOE-140. Group 4 served as a positive control for inhibition of captopril-induced vascular permeability.

Group 5 consisted of 8 mice and was treated with 40 mg/kg of ISIS 482584 administered subcutaneously twice a week for 4 weeks. Group 5 served as an experimental treatment group for examining the effect of ISIS 482584 on basal vascular permeability.

Group 6 consisted of 8 mice and was treated with 40 mg/kg of ISIS 482584 administered subcutaneously twice a week for 4 weeks. At the end of the treatment period, the mice were intraperitoneally administered 20 μg of captopril. Group 6 served as an experimental treatment group for examining the effect of ISIS 482584 on captopril-induced vascular permeability.

All the groups were then injected with 30 mg/kg of Evans Blue solution. The mice were sacrificed 30 min after the Evans Blue solution administration and colons, feet, ears, and intestines were harvested.

TABLE 184

Treatment groups

| Group No. | Treatment | Captopril | HOE-140 |
|---|---|---|---|
| 1. (N = 8) | PBS | No | No |
| 2. (N = 8) | PBS | Yes | No |
| 3. (N = 8) | PBS | No | Yes |
| 4. (N = 8) | PBS | Yes | Yes |
| 5. (N = 8) | ISIS 482584 | No | No |
| 6. (N = 8) | ISIS 482584 | Yes | No |

Quantification of Vascular Permeability

The harvested tissues from the feet, colon, intestine, and ears were placed separately in formamide solution overnight to leach out the Evans Blue dye. The formamide solution containing feet and ear tissue was heated to 55° C. and left overnight. The color intensity of the dye-infused formamide solution was then measured at $OD_{600nm}$, and is presented in Table 185. Mice displaying any manifestation of angioedema take up more dye and, therefore, demonstrate high OD values.

As presented in Table 185, mice treated with ISIS 482584 demonstrated reduced basal vascular permeability compared to the PBS control (Group 5 vs. Group 1). The reduction in basal vascular permeability by treatment with ISIS 482584 was comparable to that caused by treatment with HOE-140 (Group 3, which served as the positive control). Mice treated with ISIS 482584 also demonstrated reduced captopril-induced vascular permeability in most tissues compared to the PBS control (Group 6 vs. Group 2). The reduction in captopril-induced vascular permeability by treatment with ISIS 482584 was comparable to that caused by treatment with HOE-140 (Group 4, which served as the positive control).

TABLE 185

OD$_{600 nm}$ of Evans Blue dye to measure vascular permeability

| Group No. | Treatment | Capto-pril | HOE-140 | Co-lon | Feet | Intes-tine | Ears |
|---|---|---|---|---|---|---|---|
| 1 | PBS | No | No | 0.27 | 0.08 | 0.23 | 0.06 |
| 2 | PBS | Yes | No | 0.61 | 0.08 | 0.24 | 0.01 |
| 3 | PBS | No | Yes | 0.18 | 0.06 | 0.21 | 0.03 |
| 4 | PBS | Yes | Yes | 0.29 | 0.03 | 0.14 | 0.00 |
| 5 | ISIS 482584 | No | No | 0.19 | 0.07 | 0.22 | 0.04 |
| 6 | ISIS 482584 | Yes | No | 0.37 | 0.05 | 0.22 | 0.00 |

Example 126

Dose-dependent Effect of Antisense Inhibition of Murine PKK on Captopril-induced Vascular Permeability The effect of varying doses on ISIS 482584 on captopril-induced vascular permeability was evaluated.

Treatment

The various treatment groups for this assay are presented in Table 186.

Group 1 consisted of 4 mice and was treated with PBS administered subcutaneously twice a week for 3 weeks. No other treatment was administered to Group 1 which served as a control group to measure the basal levels of vascular permeability.

Group 2 consisted of 8 mice and was treated with PBS administered subcutaneously twice a week for 3 weeks. At the end of the treatment period, the mice were intraperitoneally administered 20 µg of captopril. Group 2 served as the control group for captopril-induced vascular permeability.

Group 3 consisted of 4 mice and was treated with PBS administered subcutaneously twice a week for 3 weeks. At the end of the treatment period, the mice were intraperitoneally administered 20 µg of captopril. The mice were also intraperitoneally administered 30 µg of Icatibant (HOE-140). Group 4 served as a positive control for inhibition of captopril-induced vascular permeability.

Groups 4, 5, 6, 7, 8, and 9 consisted of 8 mice each and were treated with 2.5 mg/kg, 5 mg/kg, 10 mg/kg, 20 mg/kg, 40 mg/kg, or 80 mg/kg (corresponding to 5 mg/kg, 10 mg/kg, 20 mg/kg, 40 mg/kg, 80 mg/kg, or 160 mg/kg per week), respectively of ISIS 482584 administered subcutaneously twice a week for 3 weeks. At the end of the treatment period, the mice of all the groups were intraperitoneally administered 20 g of captopril. Groups 4-9 served as the experimental treatment groups for examining the effect of varying doses of ISIS 482584 on captopril-induced vascular permeability.

All the groups were then injected with 30 mg/kg of Evans Blue solution in the tail vein. The mice were sacrificed 30 min after the Evans Blue solution administration and colons, feet, ears, and intestines were harvested. Blood samples were taken through cardiac puncture.

TABLE 186

| | Treatment groups | | | |
|---|---|---|---|---|
| Group No. | Treatment | Dose (mg/kg/wk) | Captopril | HOE-140 |
| 1. (N = 4) | PBS | — | No | No |
| 2. (N = 8) | PBS | — | Yes | No |
| 3. (N = 4) | PBS | — | Yes | Yes |
| 4. (N = 8) | ISIS 482584 | 160 | Yes | No |
| 5. (N = 8) | ISIS 482584 | 80 | Yes | No |
| 6. (N = 8) | ISIS 482584 | 40 | Yes | No |
| 7. (N = 8) | ISIS 482584 | 20 | Yes | No |
| 8. (N = 8) | ISIS 482584 | 10 | Yes | No |
| 9. (N = 8) | ISIS 482584 | 5 | Yes | No |

Quantification of Vascular Permeability

The harvested tissues were placed in formamide solution overnight to leach out the Evans Blue dye. The formamide solution containing feet and ear tissue was heated to 55° C. and left overnight. The color intensity of the dye-infused formamide solution was then measured at OD$_{600nm}$, and is presented in Table 187. Mice displaying any manifestation of angioedema take up more dye and, therefore, demonstrate high OD values.

As presented in Table 187, mice treated with higher doses of ISIS 482584 (Groups 4, 5, and 6) had reduced levels of captopril-induced vascular permeability compared to the corresponding PBS control group (Group 2). The reduction in vascular permeability in mice of these treatment groups (Groups 4 and 5) was comparable to the levels of basal vascular permeability (as shown in Group 1) as well as in mice treated with HOE-140 (Group 3).

TABLE 187

OD$_{600 nm}$ of Evans Blue dye to measure vascular permeability

| Group No. | Treatment | Dose (mg/kg) | Capto-pril | HOE-140 | Co-lon | Feet | Intes-tine | Ears |
|---|---|---|---|---|---|---|---|---|
| 1 | PBS | — | No | No | 0.16 | 0.07 | 0.13 | 0.01 |
| 2 | PBS | — | Yes | No | 0.39 | 0.12 | 0.18 | 0.07 |
| 3 | PBS | — | Yes | Yes | 0.15 | 0.03 | 0.10 | 0.04 |
| 4 | ISIS 482584 | 160 | Yes | No | 0.26 | 0.10 | 0.15 | 0.05 |
| 5 | ISIS 482584 | 80 | Yes | No | 0.21 | 0.04 | 0.17 | 0.03 |
| 6 | ISIS 482584 | 40 | Yes | No | 0.36 | 0.10 | 0.20 | 0.05 |
| 7 | ISIS 482584 | 20 | Yes | No | 0.40 | 0.11 | 0.20 | 0.07 |
| 8 | ISIS 482584 | 10 | Yes | No | 0.41 | 0.10 | 0.19 | 0.05 |
| 9 | ISIS 482584 | 5 | Yes | No | 0.41 | 0.10 | 0.17 | 0.05 |

Quantification of Vascular Leakage

The blood drawn through cardiac puncture was immediately mixed with 3 times the volume of ice-cold ethanol. The solution was centrifuged at 15,000 g for 20 minutes at 4° C. to remove cell debris and precipitated plasma proteins. The ethanol extracts were further purified by ultra-filtration through a 10 kDa MWCO filter. The color intensity of the ethanol extracted plasma solution was then measured at OD$_{620nm}$. The results are presented in Table 188 as percentage increase or decrease of the OD values of the Group 1 PBS control. It was expected that tissues from mice displaying manifestation of angioedema would leak more dye from the plasma and, therefore, demonstrate low OD values, whereas treatment groups may display higher OD values due to reduced vascular leakage. Mice treated with 160 mg/kg/ week and 80 mg/kg/week of ISIS 482584 (Groups 4 and 5) demonstrated less vascular leakage compared to the PBS negative control treated with captopril (Group 2). The results from Groups 4 and 5 were comparable to the positive control treated with HOE-140 (Group 3).

TABLE 188

Percentage of $OD_{620nm}$ of Evans Blue dye compared to the PBS basal control to measure vascular leakage

| Group No. | Treatment | Dose (mg/kg) | Captopril | HOE-140 | Plasma |
|---|---|---|---|---|---|
| 2 | PBS | — | Yes | No | −43 |
| 3 | PBS | — | Yes | Yes | 5 |
| 4 | ISIS 482584 | 160 | Yes | No | 91 |
| 5 | ISIS 482584 | 80 | Yes | No | 40 |
| 6 | ISIS 482584 | 40 | Yes | No | −31 |
| 7 | ISIS 482584 | 20 | Yes | No | −26 |
| 8 | ISIS 482584 | 10 | Yes | No | −20 |
| 9 | ISIS 482584 | 5 | Yes | No | −23 |

Example 127

Dose-dependent Effect of Antisense Inhibition of Murine PKK on Basal Permeability in Mice The effect of varying doses on ISIS 482584 on basal vascular permeability was evaluated.

Treatment

The various treatment groups for this assay are presented in Table 189.

Group 1 consisted of 8 mice and was treated with PBS administered subcutaneously twice a week for 3 weeks. No other treatment was administered to Group 1 which served as a control group to measure the basal levels of vascular permeability.

Group 2 consisted of 4 mice and was treated with PBS administered subcutaneously twice a week for 3 weeks. At the end of the treatment period, the mice were intraperitoneally administered 30 µg of HOE-140. Group 2 served as a positive control for inhibition of basal vascular permeability.

Groups 3, 4, 5, 6, 7, and 8 consisted of 8 mice each and were treated with 2.5 mg/kg, 5 mg/kg, 10 mg/kg, 20 mg/kg, 40 mg/kg, or 80 mg/kg (corresponding to 5 mg/kg, 10 mg/kg, 20 mg/kg, 40 mg/kg, 80 mg/kg, or 160 mg/kg per week), respectively of ISIS 482584 administered subcutaneously twice a week for 3 weeks. Groups 4-9 served as the experimental treatment groups for examining the effect of varying doses of ISIS 482584 on basal vascular permeability.

All the groups were then injected with 30 mg/kg of Evans Blue solution in the tail vein. The mice were sacrificed 30 min after the Evans Blue solution administration and colons, feet, and ears were harvested and examined for permeability defects. Blood samples were taken through cardiac puncture.

TABLE 189

Treatment groups

| Group No. | Treatment | Dose (mg/kg/week) | HOE-140 |
|---|---|---|---|
| 1. (N = 8) | PBS | — | No |
| 2. (N = 4) | PBS | — | Yes |
| 3. (N = 8) | ISIS 482584 | 160 | No |

TABLE 189-continued

Treatment groups

| Group No. | Treatment | Dose (mg/kg/week) | HOE-140 |
|---|---|---|---|
| 4. (N = 8) | ISIS 482584 | 80 | No |
| 5. (N = 8) | ISIS 482584 | 40 | No |
| 6. (N = 8) | ISIS 482584 | 20 | No |
| 7. (N = 8) | ISIS 482584 | 10 | No |
| 8. (N = 8) | ISIS 482584 | 5 | No |

Quantification of Vascular Permeability

The harvested tissues from the feet, colon, and ears were placed in formamide solution overnight to leach out the Evans Blue dye. The formamide solution containing feet and ear tissue was heated to 55° C. and left overnight. The color intensity of the dye-infused formamide solution was then measured at $OD_{600nm}$, and is presented in Table 190. Higher OD values are associated with higher levels of permeability.

As presented in Table 190, most of the tissues of mice treated with ISIS 482584 at all doses (Groups 3-8) demonstrated reduced basal vascular permeability compared to the PBS control (Group 1). The reduction in basal vascular permeability of the ISIS oligonucleotide-treated groups was comparable to the same demonstrated in the positive control group treated with HOE-140 (Group 2).

TABLE 190

$OD_{600\,nm}$ of Evans Blue dye to measure vascular permeability

| Group No. | Treatment | Dose (mg/kg/week) | HOE-140 | Colon | Feet | Ears |
|---|---|---|---|---|---|---|
| 1 | PBS | — | No | 0.27 | 0.17 | 0.013 |
| 2 | PBS | — | Yes | 0.24 | 0.09 | 0.047 |
| 3 | ISIS 482584 | 160 | No | 0.25 | 0.11 | 0.019 |
| 4 | ISIS 482584 | 80 | No | 0.24 | 0.09 | 0.014 |
| 5 | ISIS 482584 | 40 | No | 0.27 | 0.11 | 0.011 |
| 6 | ISIS 482584 | 20 | No | 0.26 | 0.11 | 0.009 |
| 7 | ISIS 482584 | 10 | No | 0.31 | 0.10 | 0.015 |
| 8 | ISIS 482584 | 5 | No | 0.32 | 0.11 | 0.009 |

Quantification of Vascular Leakage

The blood drawn through cardiac puncture was immediately mixed with 3 times the volume of ice-cold ethanol. The solution was centrifuged at 15,000 g for 20 minutes at 4° C. to remove cell debris and precipitated plasma proteins. The ethanol extracts were further purified by ultra-filtration through a 10 kDa MWCO filter. The color intensity of the ethanol extracted plasma solution was then measured at $OD_{620nm}$. The results are presented in Table 191 as percentage increase or decrease of the OD values of the Group 1 PBS control. It was expected that treatment groups may display higher OD values due to reduced vascular leakage. All the mice in the ISIS oligonucleotide-treated groups demonstrated significantly reduced vascular leakage compared to the PBS negative control.

TABLE 191

Percentage of $OD_{620nm}$ of Evans Blue dye compared to the PBS basal control to measure vascular leakage

| Group No. | Treatment | Dose (mg/kg/week) | HOE-140 | Plasma |
|---|---|---|---|---|
| 2. (N = 8) | ISIS 482584 | 160 | No | 95 |
| 3. (N = 8) | ISIS 482584 | 80 | No | 93 |
| 4. (N = 8) | ISIS 482584 | 40 | No | 83 |
| 5. (N = 8) | ISIS 482584 | 20 | No | 56 |
| 6. (N = 8) | ISIS 482584 | 10 | No | 36 |

Quantification of High Molecular Weight Kininogen (HMWK)

Western blot quantification of HMWK from blood samples are presented in Tables 192 and 193.

As shown in Table 192, Groups treated with 482584 have higher levels of HMWK as compared to PBS control, increasing in a dose-dependent manner. Treatment with PKK antisense oligonucleotide results in stabilization of HMWK. Thus, vascular permeability is reduced in ISIS 482584-treated groups in a dose-dependent manner. As shown in Table 193, Groups treated with ISIS 482584 have lower HMWK cleavage product as compared to PBS control, decreasing in a dose-dependent manner. Thus, reduced HMWK is caused by PKK cleavage of HMWK into cleavage products (including bradykinin and HKa). Data are presented in Intensity Units as measured by densitometer.

TABLE 192

Quantification of HMWK by densitometer

| Group No | Treatment | Dose (mg/kg/week) | Intensity Units |
|---|---|---|---|
| 1 | PBS | — | 89 |
| 3 | ISIS 482584 | 160 | 21358 |
| 4 | ISIS 482584 | 80 | 7279 |
| 5 | ISIS 482584 | 40 | 873 |
| 6 | ISIS 482584 | 20 | 608 |
| 7 | ISIS 482584 | 10 | 507 |

TABLE 193

Quantification of HMWK cleavage product by densitometer

| Group No | Treatment | Dose (mg/kg/week) | Intensity Units |
|---|---|---|---|
| 1 | PBS | — | 401738 |
| 3 | ISIS 482584 | 160 | 19936 |
| 4 | ISIS 482584 | 80 | 204482 |
| 5 | ISIS 482584 | 40 | 388135 |
| 6 | ISIS 482584 | 20 | 403360 |
| 7 | ISIS 482584 | 10 | 414774 |

Example 128

Combination Therapy of Antisense Oligonucleotides Targeting PKK and Factor 12 on Captopril-induced Vascular Permeability in Mice Mice were treated varying doses of ISIS 410944, a 5-10-5 MOE gapmer targeting Factor 12 (GCATGGGACAGAGATGGTGC; SEQ ID NO: 2247), and ISIS 482584 in a captopril-induced vascular permeability model.

Treatment

The various treatment groups for this assay are presented in Table 194.

Group 1 consisted of 4 mice and was treated with PBS administered subcutaneously twice a week for 3 weeks. No other treatment was administered to Group 1 which served as a control group to measure the basal levels of vascular permeability.

Group 2 consisted of 8 mice and was treated with PBS administered subcutaneously twice a week for 3 weeks. At the end of the treatment period, the mice were intraperitoneally administered 20 μg of captopril. Group 2 served as the control group for captopril-induced vascular permeability.

Group 3 consisted of 4 mice and was treated with PBS administered subcutaneously twice a week for 3 weeks. At the end of the treatment period, the mice were intraperitoneally administered 20 μg of captopril. The mice were also intraperitoneally administered 30 μg of HOE-140. Group 3 served as a positive control for inhibition of captopril-induced vascular permeability.

Groups 4, 5, 6, 7, and 8 consisted of 8 mice each and were treated with 2.5 mg/kg, 5 mg/kg, 10 mg/kg, 20 mg/kg, or 40 mg/kg (corresponding to 5 mg/kg, 10 mg/kg, 20 mg/kg, 40 mg/kg, or 80 mg/kg per week), respectively of ISIS 482584 and ISIS 410944 each administered subcutaneously twice a week for 3 weeks. At the end of the treatment period, the mice of all the groups were intraperitoneally administered 20 μg of captopril. Groups 4-8 served as the experimental treatment groups for examining the effect of ISIS 410944 and ISIS 482584 on captopril-induced vascular permeability.

All the groups were then injected with 30 mg/kg of Evans Blue solution in the tail vein. The mice were sacrificed 30 min after the Evans Blue solution administration and colons, feet, ears, and intestines were harvested.

TABLE 194

Treatment groups

| Group No. | Treatment | Dose (mg/kg/wk) of each ASO | Captopril | HOE-140 |
|---|---|---|---|---|
| 1. (N = 4) | PBS | — | No | No |
| 2. (N = 8) | PBS | — | Yes | No |
| 3. (N = 4) | PBS | — | Yes | Yes |
| 4. (N = 8) | ISIS 482584 + ISIS 410944 | 80 | Yes | No |
| 5. (N = 8) | ISIS 482584 + ISIS 410944 | 40 | Yes | No |
| 6. (N = 8) | ISIS 482584 + ISIS 410944 | 20 | Yes | No |
| 7. (N = 8) | ISIS 482584 + ISIS 410944 | 10 | Yes | No |
| 8. (N = 8) | ISIS 482584 + ISIS 410944 | 5 | Yes | No |

Quantification of Vascular Permeability

The harvested tissues from the feet, colon, and ears were placed in formamide solution overnight to leach out the Evans Blue dye. The formamide solution containing feet and ear tissue was heated to 55° C. and left overnight. The color intensity of the dye-infused formamide solution was then measured at $OD_{600nm}$, and is presented in Table 195. Higher OD values are associated with higher levels of permeability.

As presented in Table 195, most of the tissues of mice treated with a combination of ISIS 482584 and ISIS 410944 at all doses (Groups 3-8) demonstrated reduced vascular permeability compared to the PBS control (Group 1). The reduction in vascular permeability of the ISIS oligonucleotide-treated groups was comparable to the same demonstrated in the basal PBS control (Group 1), as well as the positive control group treated with HOE140 (Group 2). Combination of PKK and Factor 12 antisense oligonucleotides results in synergistic decrease in permeability. As expected, a corresponding synergistic decrease in vascular leakage was also observed.

and ISIS 410944 each administered subcutaneously twice a week for 3 weeks. Groups 3-7 served as the experimental treatment groups for examining the effect of ISIS 410944 and ISIS 482584 on basal vascular permeability.

All the groups were then injected with 30 mg/kg of Evans Blue solution in the tail vein. The mice were sacrificed 30 min after the Evans Blue solution administration and colons, feet, ears, and intestines were harvested.

TABLE 195

$OD_{600\,nm}$ of Evans Blue dye to measure vascular permeability

| Group No. | Treatment | Dose (mg/kg/wk) of each ASO | Captopril | HOE-140 | Colon | Feet | Intestines | Ears |
|---|---|---|---|---|---|---|---|---|
| 1 | PBS | — | No | No | 0.24 | 0.11 | 0.13 | 0.01 |
| 2 | PBS | — | Yes | No | 0.38 | 0.15 | 0.11 | 0.05 |
| 3 | PBS | — | Yes | Yes | 0.23 | 0.06 | 0.15 | 0.04 |
| 4 | ISIS 482584 + ISIS 410944 | 80 | Yes | No | 0.19 | 0.07 | 0.11 | 0.04 |
| 5 | ISIS 482584 + ISIS 410944 | 40 | Yes | No | 0.19 | 0.07 | 0.12 | 0.03 |
| 6 | ISIS 482584 + ISIS 410944 | 20 | Yes | No | 0.22 | 0.08 | 0.12 | 0.04 |
| 7 | ISIS 482584 + ISIS 410944 | 10 | Yes | No | 0.38 | 0.13 | 0.13 | 0.05 |
| 8 | ISIS 482584 + ISIS 410944 | 5 | Yes | No | 0.53 | 0.12 | 0.13 | 0.03 |

Example 129

Combination Therapy of Antisense Oligonucleotides Targeting PKK and Factor 12 on Basal Vascular Permeability in Mice Mice were treated with varying doses of ISIS 410944, an antisense oligonucleotide targeting Factor 12, and ISIS 482584 in a basal vascular permeability model.
Treatment The various treatment groups for this assay are presented in Table 196.

Group 1 consisted of 8 mice and was treated with PBS administered subcutaneously twice a week for 3 weeks. No other treatment was administered to Group 1 which served as a control group to measure the basal levels of vascular permeability.

Group 2 consisted of 4 mice and was treated with PBS administered subcutaneously twice a week for 3 weeks. At the end of the treatment period, the mice were intraperitoneally administered 30 μg of HOE-140. Group 2 served as a positive control for inhibition of basal vascular permeability.

Groups 3, 4, 5, 6, and 7 consisted of 8 mice each and were treated with 2.5 mg/kg, 5 mg/kg, 10 mg/kg, 20 mg/kg, or 40 mg/kg (corresponding to 5 mg/kg, 10 mg/kg, 20 mg/kg, 40 mg/kg, or 80 mg/kg per week), respectively of ISIS 482584

TABLE 196

Treatment groups

| Group No. | Treatment | Dose (mg/kg/wk) | HOE-140 |
|---|---|---|---|
| 1. (N = 8) | PBS | — | No |
| 2. (N = 4) | PBS | — | Yes |
| 3. (N = 8) | ISIS 482584 + ISIS 410944 | 80 | No |
| 4. (N = 8) | ISIS 482584 + ISIS 410944 | 40 | No |
| 5. (N = 8) | ISIS 482584 + ISIS 410944 | 20 | No |
| 6. (N = 8) | ISIS 482584 + ISIS 410944 | 10 | No |
| 7. (N = 8) | ISIS 482584 + ISIS 410944 | 5 | No |

Quantification of Vascular Permeability

The harvested tissues from the feet, colon, intestines, and ears were placed in formamide solution overnight to leach out the Evans Blue dye. The formamide solution containing feet and ear tissue was heated to 55° C. and left overnight. The color intensity of the dye-infused formamide solution was then measured at $OD_{600nm}$, and is presented in Table 197. Higher OD values are associated with higher levels of permeability.

As presented in Table 197, most of the tissues of mice treated with a combination of ISIS 482584 and ISIS 410944 at all doses (Groups 2-7) demonstrated reduced vascular permeability compared to the PBS control (Group 1). The reduction in vascular permeability of the ISIS oligonucleotide-treated groups was comparable to the same demonstrated in positive control group treated with HOE140 (Group 2). Combination of PKK and Factor 12 antisense oligonucleotides results in synergistic decrease in permeability. As expected, a corresponding synergistic decrease in vascular leakage was also observed.

TABLE 197

$OD_{600\ nm}$ of Evans Blue dye to measure vascular permeability

| Group No. | Treatment | Dose (mg/kg/wk) | HOE-140 | Colon | Feet | Intestines | Ears |
|---|---|---|---|---|---|---|---|
| 1 | PBS | — | No | 0.19 | 0.08 | 0.10 | 0.004 |
| 2 | PBS | — | Yes | 0.14 | 0.04 | 0.08 | 0.008 |
| 3 | ISIS 482584 + ISIS 410944 | 80 | No | 0.14 | 0.04 | 0.09 | 0.01 |
| 4 | ISIS 482584 + ISIS 410944 | 40 | No | 0.15 | 0.05 | 0.10 | 0.006 |
| 5 | ISIS 482584 + ISIS 410944 | 20 | No | 0.15 | 0.04 | 0.10 | 0.007 |
| 6 | ISIS 482584 + ISIS 410944 | 10 | No | 0.15 | 0.06 | 0.10 | 0.004 |
| 7 | ISIS 482584 + ISIS 410944 | 5 | No | 0.14 | 0.05 | 0.13 | 0.002 |

Example 130

Inhibition of Factor 12 Protein Activation by ISIS 482584

The effect of antisense inhibition of PKK mRNA on Factor 12 protein activation was evaluated.

Treatment

The various treatment groups for this assay are presented in Table 198.

Group 1 consisted of 8 mice and was treated with PBS administered subcutaneously twice a week for 3 weeks. No other treatment was administered to Group 1 which served as a control group to measure Factor 12 activation.

Groups 2, 3, 4, 5, and 6 consisted of 8 mice each and were treated with 2.5 mg/kg, 5 mg/kg, 10 mg/kg, 20 mg/kg, or 40 mg/kg (corresponding to 5 mg/kg, 10 mg/kg, 20 mg/kg, 40 mg/kg, or 80 mg/kg per week), respectively of ISIS 482584 administered subcutaneously twice a week for 3 weeks. Groups 2-6 served as the treatment groups for measuring the effect of ISIS 482584 on Factor 12 activation.

At the end of the treatment period, plasma was harvested from the mice for the Spectrozyme® Factor 12a based amidolytic assay for Factor 12 in plasma.

TABLE 198

Treatment groups

| Group No. | Treatment | Dose (mg/kg/wk) |
|---|---|---|
| 1. (N = 8) | PBS | — |
| 2. (N = 8) | ISIS 482584 | 80 |
| 3. (N = 8) | ISIS 482584 | 40 |
| 4. (N = 8) | ISIS 482584 | 20 |
| 5. (N = 8) | ISIS 482584 | 10 |
| 6. (N = 8) | ISIS 482584 | 5 |

Assay for Factor 12 Activation in Plasma

Plasma (5 µL) was added to 85 µL of PBS with 1 ug/ml dextran sulfate (500 kDa) in a 96 well polypropelene microplate and the solution was incubated for 5 minutes at room temperature. Spectrozyme® FXIIa (10 µL of a 2 mM solution) and 0.2 mM KALLISTOP™ solution was added and the absorbance kinetic was measured at 405 nm. Factor 12 activation was measured in the linear phase of absorbance accumulation. The results are presented in Table 199 as a percentage of Factor 12 activation measured in the PBS control sample. As observed in Table 199, inhibition of PKK by ISIS 482584 results in decreased activation of Factor 12 by its substrate, implying the that PKK is required for proper factor 12 activation.

TABLE 199

Percentage Factor 12 activation compared to the PBS control

| Dose (mg/kg/wk) | % F12 activation |
|---|---|
| 80 | 14 |
| 40 | 24 |
| 20 | 47 |
| 10 | 63 |
| 5 | 82 |

Example 131

In Vivo Effect of Antisense Inhibition of Murine PKK on C1-INH Antisense Oligonucleotide-induced Vascular Permeability Vascular permeability induced by ISIS 461756, an antisense oligonucleotide which targets murine C1 inhibitor mRNA, increases vascular permeability in mice and replicates the pathology of hereditary angioedema. The effect of ISIS 482584 on this model was evaluated.

Treatment

One group of 8 mice was treated with 40 mg/kg ISIS 482584 administered subcutaneously twice a week for 3 weeks (weekly dose of 80 mg/kg). A second group of 8 mice was treated with 40 mg/kg of the control oligonucleotide, ISIS 141923, administered subcutaneously twice a week for 3 weeks (weekly dose of 80 mg/kg). A third group of 8 mice was treated with PBS administered subcutaneously twice a week for 3 weeks. On day 14, all the groups were treated with 12.5 mg/kg ISIS 461756 administered subcutaneously twice a week for 3 weeks (weekly dose of 25 mg/kg). A control group of mice was treated with PBS administered subcutaneously twice a week for 3 weeks but was not administered ISIS 461756.

At the end of the treatment period, all the groups were injected with 30 mg/kg of Evans Blue solution into the tail vein. The mice were sacrificed 30 min after the Evans Blue solution administration and colons, feet, ears, and intestines were harvested. The liver was also harvested for RNA analysis.

RNA Analysis

RNA was isolated from the liver for RT-PCR analysis of C1-INH and PKK mRNAs. The primer probe set for C1-INH is RTS3218 (forward sequence GAGTCCCCCA-GAGCCTACAGT, designated herein as SEQ ID NO: 2234; reverse sequence TGTCATTTGTTATTGTGATGGCTACA, designated herein as SEQ ID NO: 2235; probe sequence CTGCCCTCTACCTGGCCAACAACCA, designated herein as SEQ ID NO: 2236). The primer probe set for PKK is RTS3287 (forward sequence ACAAGTGCATTTTACA-GACCAGAGTAC, designated herein as SEQ ID NO: 2237; reverse sequence GGTTGTCCGCTGACTTTATGCT, designated herein as SEQ ID NO: 2238; probe sequence AAGCACAGTGCAAGCGGAACACCC, designated herein as SEQ ID NO: 2239). The results are presented in Table 200 as percent inhibition compared to the PBS control not treated with ISIS 461756. The data indicates that ISIS 461756 significantly reduced C1-INH mRNA expression and that treatment with ISIS 482584 significantly reduced PKK expression.

TABLE 200

Percent inhibition of mRNA expression in mice treated with ISIS 461756 compared to the untreated PBS control

| Treatment | C1-INH mRNA | PKK mRNA |
|---|---|---|
| PBS | 76 | 0 |
| ISIS 141923 | 79 | 0 |
| ISIS 482584 | 77 | 78 |

Quantification of Vascular Permeability

The harvested tissues from the feet, colon, and intestines were placed in formamide solution overnight to leach out the Evans Blue dye. The formamide solution containing feet tissue was heated to 55° C. and left overnight. The color intensity of the dye-infused formamide solution was then measured at $OD_{600nm}$. The data is presented in Table 201 as percent increase or reduction compared to the PBS control not treated with ISIS 461756. The data indicates that treatment with ISIS 482584 prevented vascular permeability induced by ISIS 461756.

TABLE 201

Percent change in vascular permeability in mice treated with ISIS 461756 compared to the untreated PBS control

| Treatment | Colon | Feet | Intestines |
|---|---|---|---|
| PBS | 13 | 70 | 27 |
| ISIS 141923 | 2 | 80 | 14 |
| ISIS 482584 | −23 | 2 | −25 |

Example 132

In Vivo Effect of Antisense Inhibition of Murine PKK in the FeCl$_3$-induced Inferior Vena Cava Thrombosis Model ISIS 482584, which demonstrated significant in vitro and in vivo inhibition of PKK, was evaluated in the FeCl$_3$-induced inferior vena cava thrombosis mouse model.

Treatment

Three groups of 8 male BALB/c mice were treated with 10 mg/kg, 20 mg/kg, or 40 mg/kg of ISIS 482584, administered subcutaneously twice a week for 3 weeks (weekly doses of 20 mg/kg, 40 mg/kg, or 80 mg/kg). Two control groups of 12 BALB/c mice each were treated with PBS, administered subcutaneously twice a week for 3 weeks. Two days after the last dose of antisense oligonucleotide or PBS, mice from all groups were anesthetized with 150 mg/kg ketamine mixed with 10 mg/kg xylazine, administered by intraperitoneal injection. Thrombus formation was induced with FeCl$_3$ in all groups of anesthetized mice except the first control group.

In mice undergoing FeCl$_3$ treatment, thrombus formation was induced by applying a piece of filter paper (2×4 mm) pre-saturated with 10% FeCl$_3$ solution directly on the vena cava. After 3 minutes of exposure, the filter paper was removed. Thirty minutes after the filter paper application, a fixed length of the vein containing the thrombus was dissected out for platelet analysis. Liver was collected for RNA analysis.

Quantification of Platelet Composition

Real-time PCR quantification of platelet factor-4 (PF-4) was used to quantify platelets in the vena cava as a measure of thrombus formation. PF-4 mRNA levels were measured using the murine primer probe set mPF4_LTS_00086 (forward sequence AGACCCATTTCCTCAAGGTAGAACT, designated herein as SEQ ID NO: 2240; reverse sequence CGCAGCGACGCTCATG, designated herein as SEQ ID NO: 2241; probe sequence TCTTTGGGTCCAGTGGCAC-CCTCTT, designated herein as SEQ ID NO: 2242). Results are presented as a percentage of PF-4 in ISIS oligonucleotide-treated mice, as compared to the two PBS-treated control groups. As shown in Table 202, treatment with ISIS 482584 resulted in a significant reduction of PF-4 in comparison to the PBS control. Therefore, reduction of PKK by the compound provided herein is useful for inhibiting thrombus formation.

TABLE 202

Analysis of thrombus formation by real-time PCR quantification of PF-4 in the FeCl$_3$ induced venous thrombosis model

| | Dose in mg/kg/wk | PF-4 |
|---|---|---|
| PBS − FeCl$_3$ | — | 0 |
| PBS + FeCl$_3$ | — | 100 |
| ISIS 482584 | 20 | 62 |
| | 40 | 34 |
| | 80 | 25 |

Example 133

In vivo Effect of Antisense Inhibition of Murine PKK in a Tail Bleeding Assay

Tail-bleeding was measured to observe whether treatment with ISIS 482584 causes excess bleeding or hemorrhage in mice.

Treatment

Groups of 10 male BALB/c mice were treated with 10 mg/kg, 20 mg/kg, or 40 mg/kg of ISIS 482584, administered subcutaneously twice a week for 3 weeks (weekly doses of 20 mg/kg, 40 mg/kg, or 80 mg/kg). A control group of 8 BALB/c mice was treated with PBS, administered subcutaneously twice a week for 3 weeks.

Tail-bleeding Assay

Two days after the final treatment of ISIS oligonucleotides or PBS, mice were placed in a tail bleeding chamber. Mice were anesthetized in the chamber with isoflurane. Then, a small piece of tail (approximately 4 mm from the tip) was cut with sterile scissors. The cut tail was immediately placed in a 15 mL Falcon tube filled with approximately 10 mL of 0.9% NaCl buffer solution warmed to 37° C. The blood was collected over the course of 40 minutes. The saline filled tubes were weighed both before and after bleeding. The results are provided in Table 203.

Treatment with ISIS 482584 did not significantly affect bleeding. These data suggest that the hemorrhagic potential of the compounds provided herein is low. These data taken with the results provided in Example 19 suggest inhibition of PKK with the compounds described herein are useful for providing antithrombotic activity without associated bleeding risk.

TABLE 203

Tail bleeding assay after treatment with ISIS 482584

| | Dose (mg/kg/wk) | Bleeding (mL) |
|---|---|---|
| PBS | — | 0.03 |
| ISIS 482584 | 20 | 0.03 |
| | 40 | 0.14 |
| | 80 | 0.07 |

Example 134

In vivo Effect of Antisense Inhibition of Murine PKK in the FeCl$_3$ Induced Mesenteric Thrombosis Model ISIS 482584 was evaluated in the FeCl$_3$ induced mesenteric thrombosis mouse model.

Treatment

A group of 6-8 Swiss-Webster mice was treated with 40 mg/kg of ISIS 482584, administered subcutaneously twice a week for 3 weeks (weekly dose of 80 mg/kg). A control group of 6 Swiss-Webster mice was treated with PBS, administered subcutaneously twice a week for 3 weeks. Two days after the last dose of antisense oligonucleotide or PBS, mice from all groups were anesthetized with 75 mg/kg ketamine mixed with 25 mg/kg xylazine, administered by subcutaneous injection.

Rhodamine 6G dye at a dosage of 5 mg/kg was injected subcutaneously to stain platelets. Alexa-647-labeled anti-fibrinogen antibody at a dosage of 1 mg/kg was injected via tail vein injection to stain fibrin. The abdomen was opened by a middle incision. The visceral mesentery was spread on a glass coverslip and the mesenteric arterioles (70-120 μm) were located by observation under a microscope. Thrombus formation was induced by applying of cotton threads (2×0.3 mm) pre-saturated with 6% FeCl$_3$ solution directly on the target vessel. After three minutes of exposure, the thread was removed and the color intensities of both the dyes were recorded by fluorescent microscopy (Olympus FluoView 1000 confocal laser scanning microscope) with appropriate filters for 70 min.

The results for platelet aggregation in the control and treatment groups are presented in Table 204, expressed in arbitrary units (a.u.). Platelet aggregation was reduced in mice treated with ISIS 482584 at a dose of 80 mg/kg/week as compared to mice treated with PBS. The results for fibrin formation in the control and treatment groups are presented in Table 205, also expressed in arbitrary units (a.u.). Fibrin formation was reduced in mice treated with ISIS 482584 at a dose of 80 mg/kg/week as compared to mice treated with PBS. Therefore, these results suggest that ISIS 482584 inhibits thrombus formation.

TABLE 204

Analysis of platelet aggregation by real-time measurement of fluorescent intensity (a.u.) in a FeCl$_3$ induced mesenteric thrombus model

| Time (sec) | PBS | 80 mg/kg/wk |
|---|---|---|
| 752 | 54 | 74 |
| 1018 | 315 | 11 |
| 1284 | 485 | 7 |
| 1550 | 654 | 0 |
| 1815 | 1079 | 0 |
| 2081 | 1164 | 0 |
| 2347 | 1452 | 0 |
| 2613 | 1440 | 38 |
| 2879 | 1689 | 148 |
| 3144 | 1716 | 129 |
| 3410 | 1845 | 169 |
| 3676 | 1865 | 131 |
| 3944 | 2055 | 87 |

TABLE 205

Analysis of fibrin formation by real-time measurement of fluorescent intensity (a.u.) in a FeCl$_3$ induced mesenteric thrombus model

| Time (sec) | PBS | 80 mg/kg/wk |
|---|---|---|
| 752 | 9 | 54 |
| 1018 | 86 | 7 |
| 1284 | 203 | 1 |
| 1550 | 319 | 10 |
| 1815 | 521 | 16 |
| 2081 | 598 | 15 |
| 2347 | 831 | 61 |
| 2613 | 959 | 88 |
| 2879 | 1157 | 141 |
| 3144 | 1236 | 150 |
| 3410 | 1374 | 173 |
| 3676 | 1629 | 160 |
| 3944 | 1822 | 128 |

Example 135

In vivo Effect of Antisense Inhibition of Murine PKK in the Stenosis-induced Inferior Vena Cava Thrombosis Model ISIS 482584 was evaluated in the stenosis-induced inferior vena cava (IVC) thrombosis model. Reduced blood flow and endothelial damage are hallmarks of this model, also known as the St. Tomas model.

Treatment

Four groups of 6-8 BALB/c mice were treated with 5 mg/kg, 10 mg/kg, 20 mg/kg, or 40 mg/kg of ISIS 482584, administered subcutaneously twice a week for 3 weeks (weekly doses of 10 mg/kg, 20 mg/kg, 40 mg/kg, or 80 mg/kg). A control group of 8 BALB/c mice was treated with PBS, administered subcutaneously twice a week for 3 weeks. Two days after the last dose of antisense oligonucleotide or PBS was administered, mice from all groups were anesthetized with 2.5% inhalant isoflurane. The IVC of the mice was exposed via a midline abdominal incision below the left renal vein, and was separated from the abdominal aorta by blunt dissection. A 6-0 silk tie (Ethicon, UK) was placed behind the blood vessel just below the left renal vein and a metal 4-0 suture (Ethicon, UK) was placed longitudinally over the IVC to tie the silk tie on top. The metal suture was then removed. Two neurovascular surgical clips (Braun Medical Inc, PA) were placed at two separate positions below the ligation for 20 seconds each, after which they were removed. The abdominal cavity contents were then replaced and the abdomen was closed. After 24 hrs, the IVC was exposed and checked for thrombi formation. All thrombi formed were collected and fixed in 10% formalin for 24 hrs.

The thrombi were weighed and the results are presented in Table 206, expressed in milligrams. As demonstrated by the results, treatment with increasing doses of ISIS 482584 resulted in corresponding decrease in thrombus weight. The results indicate that antisense inhibition of PKK is useful for inhibiting thrombus formation.

TABLE 206

Thrombi weights in the stenosis-induced IVC thrombosis model

| | Dose in mg/kg/wk | Weight (mg) |
|---|---|---|
| PBS | — | 10 |
| ISIS 482584 | 10 | 8 |
| | 20 | 6 |
| | 40 | 5 |
| | 80 | 3 |

Example 136

Inhibition of Murine PKK with an Antisense Oligonucleotide Comprising a GalNAc$_3$ Conjugate Group ISIS 482584 and ISIS 722059, shown in the table below, were tested for their effects on murine PKK mRNA in vivo.

TABLE 207

ISIS 722059, comprising a GalNAc$_3$ conjugate group and its parent, ISIS 482584

| Isis No. | Sequence (5' to 3') | Chemistry | SEQ ID NO. |
|---|---|---|---|
| 482584 | G$_{es}$G$_{es}$$^m$C$_{es}$A$_{es}$T$_{es}$A$_{ds}$T$_{ds}$T$_{ds}$ G$_{ds}$G$_{ds}$T$_{ds}$T$_{ds}$T$_{ds}$T$_{ds}$T$_{ds}$G$_{es}$ G$_{es}$A$_{es}$A$_{es}$T$_{e}$ | No conjugate group and full PS | 2244 |
| 722059 | GalNAc$_3$-7$_{a-o'}$G$_{es}$G$_{es}$$^m$C$_{eo}$ A$_{eo}$T$_{es}$A$_{ds}$T$_{ds}$T$_{ds}$G$_{ds}$G$_{ds}$T$_{ds}$ T$_{ds}$T$_{ds}$T$_{ds}$T$_{ds}$G$_{eo}$G$_{eo}$A$_{es}$A$_{es}$T$_{e}$ | 5'-GalNAc$_3$-7 and mixed PS/PO | 2244 |

Subscripts:
"e" indicates 2'-MOE modified nucleoside;
"d" indicates β-D-2'-deoxyribonucleoside;
"s" indicates phosphorothioate internucleoside linkages (PS);
"o" indicates phosphodiester internucleoside linkages (PO); and
"o" indicates -O-P(=O)(OH)-.
Superscript "m" indicates 5-methylcytosines.
The structure of "GalNAc$_3$-7" is shown in Example 48.

Subscripts: "e" indicates 2'-MOE modified nucleoside; "d" indicates β-D-2'-deoxyribonucleoside; "s" indicates phosphorothioate internucleoside linkages (PS); "o" indicates phosphodiester internucleoside linkages (PO); and "o" indicates —O—P(=O)(OH)—. Superscript "m" indicates 5-methlcytosines. The structure of "GalNAc$_3$-7" is shown in Example 48.

Treatment

Four groups of four C57Bl/6J-Tyr$^{c-2J}$ mice each were treated with 5.0 mg/kg, 10.0 mg/kg, 20.0 mg/kg, or 40.0 mg/kg of ISIS 482584, administered subcutaneously twice a week for 3 weeks (weekly doses of 10.0 mg/kg, 20.0 mg/kg, 40.0 mg/kg, or 80.0 mg/kg). Four groups of four BALB/c mice each were treated with 1.0 mg/kg, 2.0 mg/kg, 4.0 mg/kg, or 8.0 mg/kg of ISIS 722059, administered subcutaneously twice a week for 3 weeks (weekly doses of 2.0 mg/kg, 4.0 mg/kg, 8.0 mg/kg, or 16.0 mg/kg). A control group of four BALB/c mice was treated with PBS, administered subcutaneously twice a week for 3 weeks. Three days after the last dose of antisense oligonucleotide or PBS, mice from all groups were anesthetized with vaporized isoflurane in air at 2.5% for induction followed by 1-2% isoflurane by nosecone for maintenance. This was followed by cervical dislocation. Following euthanasia, liver was collected for RNA analysis.

RNA Analysis

RNA was extracted from liver tissue for real-time PCR analysis of PKK. PKK mRNA levels were measured using the murine primer probe set (forward sequence ACAAGTGCATTTTACAGACCAGAGTAC, designated herein as SEQ ID NO: 2231; reverse sequence GGTTGTCCGCTGACTTTATGCT, designated herein as SEQ ID NO: 2232; probe sequence AAGCACAGTGCAAGCGGAACACCC, designated herein as SEQ ID NO: 2233). Results are presented as percent inhibition of PKK, relative to PBS control. As shown in Table 208 below, Isis 722059, comprising a GalNAc$_3$ conjugate group, reduced PKK mRNA significantly more potently than the parent antisense oligonucleotide, Isis 482584. This result is consistent with the results in the above examples, in which antisense oligonucleotides comprising a GalNAc$_3$ conjugate group were significantly more potent than their parent antisense oligonucleotides, for many target genes in both mouse and human. Thus, it is expected that human PKK antisense oligonucleotides comprising a GalNAc$_3$ conjugate group would likewise reduce human PKK mRNA significantly more potently than their parent antisense oligonucleotides that do not comprise a conjugate group.

TABLE 208

Percent Inhibition of PKK mRNA in liver relative to the PBS control

| ISIS No. | Dose (mg/kg/week) | % inhibition | ED$_{50}$ (mg/kg/week) |
|---|---|---|---|
| 482584 | 10 | 42.6 | 17.2 |
| | 20 | 53.3 | |
| | 40 | 71.4 | |
| | 80 | 90.8 | |
| 722059 | 2 | 50.1 | 2.09 |
| | 4 | 76.7 | |
| | 8 | 80.8 | |
| | 16 | 86.1 | |

Example 137

Inhibition of Human PKK with an Antisense Oligonucleotide Comprising a GalNAc$_3$ Conjugate Group ISIS 546254 and ISIS 721744, shown in the table below, were tested for their effects on human PKK mRNA in vitro.

TABLE 209

ISIS 721744, comprising a GalNAc₃ conjugate group and its parent, ISIS 546254

| Isis No. | Sequence (5' to 3') | Chemistry | SEQ ID NO. |
|---|---|---|---|
| 546254 | $T_{es}G_{es}{}^mC_{es}A_{es}A_{es}G_{ds}T_{ds}{}^mC_{ds}$ $T_{ds}{}^mC_{ds}T_{ds}T_{ds}G_{ds}G_{ds}{}^mC_{ds}A_{es}$ $A_{es}A_{es}{}^mC_{es}A_{e}$ | No conjugate group and full PS | 570 |
| 721744 | GalNAc$_3$-7$_{a-o'}$T$_{es}$G$_{es}{}^m$C$_{eo}$ A$_{eo}$A$_{es}$G$_{ds}$T$_{ds}{}^m$C$_{ds}$T$_{ds}{}^m$C$_{ds}$T$_{ds}$ T$_{ds}$G$_{ds}$G$_{ds}{}^m$C$_{ds}$A$_{eo}$A$_{eo}$A$_{es}{}^m$C$_{es}$A$_e$ | 5'-GalNAc₃-7$_{a-o'}$ and mixed PS/PO | 570 |

Subscripts:
"e" indicates 2'-MOE modified nucleoside;
"d" indicates β-D-2'-deoxyribonucleoside;
"s" indicates a phosphorothioate internucleoside linkage (PS); and "o" indicates a phosphodiester internucleoside linkage (PO).
Superscript "m" indicates 5-methylcytosine.
The structure of "GalNAc₃-7" is shown in Example 48, and "GalNAc₃-7$_{a-o'}$" indicates a GalNAc₃-7 conjugate group in which the cleavable moiety is O-P(=O)(OH)-.

Subscripts: "e" indicates 2'-MOE modified nucleoside; "d" indicates β-D-2'-deoxyribonucleoside; "s" indicates a phosphorothioate internucleoside linkages (PS); and "o" indicates a phosphodiester internucleoside linkage (PO). Superscript "m" indicates 5-methlcytosines. The structure of "GalNAc₃-7" is shown in Example 48, and "GalNAc₃-7$_{a-o'}$" indicates a GalNAc₃-7 conjugate group in which the cleavable moiety is —O—P(=O)(OH)—.

Primary human hepatocyte co-cultures that include stromal cells in order to mimic the physiological microenviroment of the liver in vitro (HepatoPac kit HPHU-TX-96S, Hepregen, Medford, Mass.) were used according to the manufacturer's instructions. A concentration of Isis oligonucleotide listed in table below or PBS was added to each well in the absence of any transfection reagent. 96 hours later, cells were lysed and RNA was isolated from the cells. PKK mRNA levels were measured by quantitative real-time PCR using primer probe set RTS3454 and normalized to total RNA content, as measured by RIBOGREEN®. The results are presented in the table below as percent inhibition of PKK mRNA levels, relative to PBS treated cells; and IC$_{50}$ values were calculated using a 4 parameter logistic model (JMP Software, Cary, N.C.). The results show that, under free uptake conditions in which no reagents or electroporation techniques were used to artificially promote entry of the oligonucleotides into cells, the oligonucleotide comprising a GalNAc conjugate was significantly more potent than the parent oligonucleotide that does not comprise a GalNAc conjugate.

TABLE 210

Percent Inhibition of PKK mRNA relative to the PBS control

| ISIS No. | Concentration (μM) | Inhibition (%) | IC$_{50}$ (μM) |
|---|---|---|---|
| 546254 | 0.1 | 30 | 2.12 |
|  | 0.3 | 25 |  |
|  | 1.0 | 24 |  |
|  | 3.0 | 63 |  |
|  | 10.0 | 85 |  |
| 721744 | 0.03 | 34 | 0.07 |
|  | 0.1 | 52 |  |
|  | 0.3 | 81 |  |
|  | 1.0 | 92 |  |
|  | 3.0 | 98 |  |

SEQUENCE LISTING (2281 sequences)

SEQ ID NO: 1 - DNA, 2252 bp, homo sapiens
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcaaaaaa

SEQ ID NO: 2 - DNA, 578 bp, homo sapiens
atgctctctctctctcctgctgccttgtgaagaaggtacctgcttccccttcaccttccaccataattctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaat

SEQ ID NO: 3 - DNA, 681 bp, homo sapiens
ggaagccattcactagtcagattgaccagagattgttggtgggctgtctgttggggtctatgcacaggatttctgctggagttctaaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccag

SEQ ID NO: 4 - DNA, 2175 bp, homo sapiens
agaacagcttgaagaccgttcatttttaagtgacaagagactcacctccaagaagcaattgtgttttcagtttcctgtgagggagttttctctgtgtccccacaaggcatgattctgggtctatggtgacttaagagggccacacaacaatgagtatttaattttcctcagatgtatggctacaataaacatctataggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtatctaaggttagcagtgttgaagaatgccaaaaaaggtgcaccaatgacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccaaatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctgtactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaagggagattcaggtggtcccttagtttgcaaacacaacggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaagacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatc

SEQ ID NO: 5 - DNA, 569 bp, homo sapiens
agtgccacattagaacagcttgaagaccgttcatttttaagtgacaagagactcacctccaagaagcaattgtgttttcagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctata

SEQ ID NO: 6 - DNA, 392 bp, homo sapiens
  misc_feature (379)..(379): n is a, c, g, or t
ttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagggtttggttgcttcttgaaagatagtgttacaggaaccctgcctcaaataagtgcttgccatcgagacatttatggagttgatatgagaggagtcaattntatgtgtctggtt

SEQ ID NO: 7 - DNA, 802 bp, homo sapiens
  misc_feature (760)..(760): n is a, c, g, or t
  misc_feature (775)..(775): n is a, c, g, or t
  misc_feature (796)..(796): n is a, c, g, or t
  misc_feature (800)..(800): n is a, c, g, or t
  misc_feature (802)..(802): n is a, c, g, or t
gggtaatcctcttcagttacttcaggtcatctagatgtatacgtgcaggcctgggcccagaggcgacattcctgtcttcttatattaataagaaaaagaaaacgaaatagtggttgccacatgaacatcttccagcatcttgcgttctcagatgtggatgttgccagggctctcactccagatgcttttgtgtgtcggaccatctgcacctatcaccccaactgcctcttctttacattctatacaaatgtatggaaaatcgagtcacaaaggcgagtatgcatggaaaatcgcatcacaaaggcgagtatgcatggggagcacttgctgctgtactttcatcacttttatagtctgagttcttaaaagtttcgttcatttccctcaaaacacttgaacctgcagtttcagtaggtactgttctgccaggtgcagattagttaagagattagcagacttctctgcctatcttctcttactttaaaacaaatgttaccattgaatcaaggaagcaatagccatgagaaaaaagaaggatctgacgcctttgaatgaagattcaaaacatgatcttcatgttttgtattagcttggagtaaaatccacttgctggcaatatagcccttaagcttgttgcctcttctctttgtttcagaaactagagccctgtttattctgatcaaggctctggcccactgtctttatctcagataacccaccctcttctgcacacagcatggagctaagagaaggtgtctangtatgtatatcatcngcagcataaatcccagaattngtcntn

SEQ ID NO: 8 - DNA, 2058 bp, homo sapiens
tcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaaggcgagtatgcatggaaaatcgcatcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaag

SEQ ID NO: 9 - DNA, 577 bp, homo sapiens
gttaccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtaaaggaaattttatttttcaaagacagttgacatgaccatttcatattctctttccccctgtgaaggcttactctttctactgttcatttcatctaggtgtaagtgtttcttaagattatctatggatggttctccaactaggattgcgtatgggacacaagggagctctggttactctttgagattgtgtaacactggggacaactctggtgagtaacctcactttttcgtggacctgtcagggatgtctgtcatgttgatagtttgcttagtcttaaggaattatgtgtcttgttctccttggttagaagggactttgattcacttctaattccaaccattagcgtcaacgctctcttttcagtctgcacaacaaaaacaagcacacgcattgttggaggaacaaactcttct

SEQ ID NO: 10 - DNA, 37000 bp, homo sapiens
agagcctctgcctagatttcacaggatgtgtggaaacacctggctgtccaggcagaagcctgctgcagggacccagccctcatggagaacctctattagggcagtgcagaggtgaactgtggggttggagcccacacacagagaccccactggagcactgcccagtggagctgtgaaaagagttcccccatcttccagatgccagaatggtagatccactgactggaaagttgcaggcactcagtgccggcccatgaaggcagccgtaggggctgtaccctgcaaagccacagggacagagctgcccaaggccttaacagcccacaccttgcatcagcatgccctgggtgtgagacaggggctccaaggagattattttggagctttaaaatttaatgacttccctgctaggttttgcatatgcttgggacctgtggcccctttattttggccaatttctcccatttggaatgggaacatttacccaattcctgtacccacattgtgttttggaagtaactaacttgttttttattttaaaggctcattgagggaagggacttgccttgtctcaaatgagactttggactcggacttttgggttactgtggaatgagttaagactttgggggactgttggaaagacatcattggttttgaaatctgaaaaggacatgagatttgggaaaggccaggggaagaatgatatggtttggctctgtgtcctcatccaaatctcgtcttgaattgtaatccccacatgggattacatgggaggggcctggtgagaggtgattggatcatggaggtggtttcccctgtgctgtgatctcatgatagtgagggatttaaaagtgacagtttcccctgcacatacacactctctctctcgtatcaccttgtgaagaaggtgtctgcttcccctctgccttccatcgtgattataagtttcctgaggcctccccagccatgggtaactgtgagtcagttaaacctcttttgtttataaattacccagtctcaggtagtatctttacagcagtgtgaaactggactaatacatctgggaaattctttttgtctccttcctttctgaaggacagctttgcctgatattatattcttggttgccaggttttgtactttcaatactttgaatatatcatcccactctctcttggcctacatgatttctgctgagaaatccaccaataatcttatgaagcttcccttgtatgtgaagaattgcttttctcttgcttctttgaaaattctctctttgtcatggtgaggatttcttttttttttttttttttttagatggagtctagctctgttgtccaggctggagtgcagtgtgcagtggcgcaatctcggctcactgcaagctccgtctcctgggttcacaccattttcctgtctcagcctctggagtagctgagactacaggtgcccaccaccacgcctggctaaattttttttgtatttttagtagagatggggtttcactgtgttagccaggatggtctcgatctcctgacctcatgatccacccatcttggcctcccaaagtgctgggattacaggcatgagccactgcacctggccgaggatctctttatatttaatctatttggagttcttttgggcttcataaatctggatgtttatttcatttatgtctccaaattttgagagttttctattcttatttttttaaataagtttctgcaactttctctttctctacttcttctggaactcttctaatgcatattaattttcttaacagtgtcctataagtcttgtcagctttctgcaatttttatcattccttttattactctgactgggtaatttcaaatgacctgtatctgagcatgctgattctttctcctgcttgatctagtctgctgctgaagctgtttgtgaattttttcaattcagtcattttgttctttagctccagaatttctgtttcattcttttttatggttcctatctatctttttgttgaacttctaattttgctcatgtattgttttcctgattttgtttactgtctatctatattgttttgtagcttattgagctttcttaaggcaattatttttagctcttgtcatgcagtaaagatctccatttctttagggtcacctcctgctgctttatttccttcctttggtggtttcttgtttccccgattatttgtgatcagtgtggccttgcactgaagtaggcacctatttcagtctttacatactagcttcagcagagaaagccattcactagtcagattgaccagagattgttggtgggctgtctgttggggtctatgcacaggatttctgctggagttctaaggtgggaagggctggattctgggttcattcactgtggttgtctgtattctgtgcacaaggactggcttgaagcatggatccttgggggctgacttggcactgaaatgagccttaagcctgcgtctgcaggggccagcctaacatggggatcacctggcacctgagttcatggggataggcctgttcctgagtttattcaggctgtcctgggaacaaggtccactggggtgagcccagcatctgggtccacatggcccagcatggagccaagatctctggaggctgacctggtgctggatctgcaggggatggcctggattctaggcccatgggtgccaacttggagcctggggttgctggggctaacgtggaggctagatagagtcttgggggccaggctagagctggagcaggcctgaagtctaggttttgtgtggccatcttggagcctgaagccccaggggctgacctggtctggggtgagcatggggctgaggccacagaggctggtctggcctgtggcaggcctgaatcctggtgctggggtttactggagtgggcttggtgcttgggatctgtggtgaagttaggttctatcttaactgtccctcctccatgcaagagggcatctctctccatactgtgctgcccaggcttgaaggtgagatgacaccggtaatgtgaaattgtccttcctatacacttctatgtgtcttttcttatttctgtgctgcaaccaggtggcataacctctcacctgattccttagctctagtgaagttattttcgtgcatggatacttgttcgaattgatgtttctgcaagggatgagcgctagaaactcctgttctgacaaactcctattcctattcttgctgacatcactccctgaaatagttaatatacttaacagctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcaggtagcaaatttttattattctgattgtttccaaataaactataatttttaagtataattttttactttatgagaaaattaatcatttatattctaatttcctgagtatgtagagagtatagataatgttcctttatgtagaaatatttaaatgtaagatgattttaaatcagaaagaatatttgattgatttaaaatttttaaatgggctttaatattttcagaggttttctttacttagggatttttggactgacattattgccattatttattaattttgtttttgcccaaatcaagaggtttcataattgtttactctctctctaccaattccctttccaacattactagccacagagttggccaatgaacaataaacacaacagtagtctggaggtctcaatttgtatcttgggaagcattataaattttccaactccctagacacaaatgtaccaaaaaaaaacccttgttttctataccagtaattgtgtgctttgtcttgcaattcagacatttacaagaaaatctaaatcaccttaaattaagatttatgttaaatgtggtctaaaaccagcagagttatgtattgttttcttttttagaatgattttattcaagcaagcaacttatttcatttccttgtttgctacagtttcctgtggtaagtgaattatctataaaacatggaattcaggctaagacaggagtagccaagcaagtggcaccacccctggagaaagctattgaacatacagcttcgggggtggagattgtccctgatgattcaggacacgtgtctatttaatgttccacaacaaggaccacttgtcaggtatattgctgtagacatatgttgcagaccagaggaaggagctcagaagtaggaatgtcttgggacttgtgttaacaaaaacttctgttcgcagatgacactctgcaaagcaaaacttgaaacaaaaaaaaattagtcctctatttttattatcaacagtaaaaaattaaactttatctgaaaattcaaaagagtgctaggcattttatagtgtctgggtccaatccaagtatctgttaggaacaccatacatagttttactctggaccgctagggaaccatttcaaaaatgaaagtaactggtttaaatttaacttagcaaaccatgcatttggatagttctaggtgaatagctttcaacaccagatttagatctcatttctctattaatttcattaatttttggagaataaaaatgattctggacatttcattaatcattacagagggagttttctctgtgtccccacaaggcatgattctgggtctatggtgacttaagagggccacacaacaatgagtatttaattttcctcagatgtatggctacaataaacatctataggtaaggtttacattcataaagagacctttttttttccaggaaaaaagacttttattccccctaaatcacaactcccctgtgtctgtccctcaaccctgatttctcttctaaaccgtaatttacaaacccatgtgcaaacccactgaaaggtgagaaggagcataagccagagacactgggaaccacagccaactacagggggtttttcatttttttgttttgttttgttttttggcaaaataaatcatgattatggctaggaaaatcagggatgtaagtaagcaaaaatttagaaactacatattgcatgtagtccccaaattcagaaacagtcatcgttaaacatcttttatttagtctttcagatatttttctacatatacctatttgcacatttcacaaaaaagagttattaactgtggacactctttgacttgcattttccacttatagctatcttttggtgcaaataagtaatatattttggagcttgctattcttctctttttatggtatttttgtgtgcacattcttatgctcttattcagttatttctgtagaatacaatttttgaaataaaaatactagattcaaaggtgtgaatatttttgaaggttttgtggtgtggtatcatgaaattaggtttcagaaagtttactccatagttgactttttctaccagctaataagagtgctcatttaccccacttaggccaactctaacaggcttctgttgctttgcatcctgacatatttatctttctggaaacagtgtcctaatttatttctgcagagctactgcctctcagttttggtccatgtggttctggtgaccctgattcttctgctgaaccagaaagtgcacacatcctcctggctgtggtgacccaatcagagccaacgtcttgcaatgaagcttttctttagacatctagaaataagactcttatgttttttttttccaatttgacttgaaacttaagacaatacacaggcctgagttgttggtactattttgctactacgtggagcttgagagtaatggtaacaccaagactggagcaagtggaaggagacatattgtccactgatgctatcagttgagcacaatgtgcagttactttttaagccagattcaccatgggctttttggctcctgaaccaatagatttcatttgttttcaagccactttgtactaggttttccatcatttgcaatcaaaaccagtatacaaacactggttatttaatttttcatttttgctaatctcagggataaaatggcttctagttgttttaacttggctatatttgtgattcttcccattttcatatacttactaatcacttctatttcttttgtaaattatcttttcatatttgttatctaattctttaaaatttgagtactttaattctcattattgtttgtggaattgttaaacaagactgaataatctgcccaaagtccatggacatgggggcccatgtaaaagctttgaaagccaccatcattatgagataaattatataatagtactttacataggctccaaaatacagcacagacacagctatcattgtcatggtcatcattatcatcatgatcaccaacttatgaggataagcaagaacacctactagaagtttctttccattcagcaacaaaattggtgtctttctagtcactcccttccctgactgtcacatagcagttcacagaggctcagttgcagaatgagaagctctgggccaggacctgccattgtatgcatccttgcatgggaactgggggctggaagaggagtgactgcttgataattatgagtcagtcaaaaccaccaactgtctgaaaaaaataggcctttttgtaactagtattgtcactaaaccaactcctccatgttttgtgcatacatgaaatctaggcaatacacttgtattcccaaaagcttccacttgaagagatctgtgctctttccaaatataaaccttacccgagaggtggtcatcttggccacacctcagagagggagagaggcagtcttgttgggttgggtggtcataatggggctcagggccaaatccccagggggtaggatagtgcagagaagatggcactctccagtgcttaataaaatgcacgtggtctaagctgcccactccctcaaaggcaataaaaaataggtactatttaaattgaagagtaactactgccccagggaatggacaggttgtcattggaatagccatggttaatggtcccagttgacaactgaaatgaatgtgctacctgaacaggaaagcttattaaccagatttcaaagacagtctttcccggtaaatccaaatttacaaattaaagccagtaaagacaccgaattctctaataatatgtggggtgcagtatattttagagctgggaataattccaaacagcaaatagttcaaaatttattttcaatttagcatatgcatgcatttgcttaaactgtcttaaaaatgagtaaaaaatactgtcagtttgtttcaatcatactgagatgaggaacaatgtttagcattgcatgctagaaaaggacacaggattgggagtcagggctgggtgaccgtcacaggactttcactaactgtgtggatcttgggcaagtctgtgtgccctgagactcagttatttaactttcttttaaaaaacatagtccagatgcagataacaaagcctgcctctaatttcccttacagaattgtgagaagctggtggagatgtttgttacaaaagtgttttgaaaatagagcaaatattattctttttaaggcatgatgttttcatagcatgtcaggcaacaggaaaaaactaagttaggattttattttattgtggggaatttatgtgcaaattattgtgcaatttaatgaaaataagccaatgttttatacagaagtacccagaaaattaaataacactatacattgttcaaatagttgccttaatatattttattttctcagcataattagagttgtattatacaggtctttgagtagtcagtcagtgggagaagttaagacaacagatatctttttattaaaattattatatgaattatcgcaaattaatttttatggttctgtcacaggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtaaaagttggtatttcattattggagaagctgtttttcaaaactgaatcagttttgtgcagaaaggtgtagtataactgagagttcttcctcacacggggttcaaggaccagcttcagcaaaatcccgtcaagtggttcttacaaatgcagattcctaggccacaacccagatctgctgaaccaaagtttcttgtgaccaggaatctgcattttaaacaatcactgtgtttctttaaagtagtagaagctagtcattttctattcaaagcctcaaaatgcttgaatatcattgggctaagggattgtctcaagaaagagtctaacaggtgcacatttcatctgaataaagaaacagatttaactgtgtgacccatgatcacattagcggatagcacagtccaaagaaaataacataagacaagcattttgctgagaatgtaattgagaaagatctagaacttgtgattttgggacagggcagttctaaatggggcctatagtgagccagtttgggcacctgtggcatgatgctatgtatggtgtgtgtgtgtatgtgtgcttgtgcttgtgtgaatatgtattattaactggaaatttgtaaaagtattggaaaaatagtacttacgattttgtgtgtgtgtgtgatggagtctcgctttgtagcccaggctggagtgcagtggcgtgatctcggctcactgcaacttccacctcccaggttcaagcgattctcctgcctcagcctcccaagtagctgggattacaggcacgcaccaccacgtccagctaatttttgtagttttagtagagacggggtttcaccacattggccaggctggccttgaactcctgacctcgtgatccacctgcctctacctcctaatgtgctgggattacaggcatgagccaccgcacccagcggtaattacaatttttattaggtcagagagatgcttattaatcacgagccacagtttcatcttaatgatttttccttttgattaatatccagagtaagcttttctttgttgttcccatttccatgttcataactctttactcatcttcactctatgtgagtttaccaactagaaattggatagtcattctctgatcccacatgttaaacttgtagagaaaactcagattgtatgtgaggatcatcatattaaaagtggaggaaggttctagaattcttataaataatgaaattaacatgaaggtggacatctaagacagagggaagtcttccattaagtgcagactacaaggagttaataagcaagatgaacacgatatacaaatccagctcttatcactaagttaactttttaagtaaatgaaagtatttgcaaaaataattaccaattgagaacatagttgcctgaaagtttaagaacacaggaaaaatcattaactctttaatatggttgatttcctgtacttaaaaaatgtgagtgtaaagaaaacgcagtgatggagttagatattatggggtgttataaaattagctctaagagtgttctttccagcaagtattggggaagctatattattttccttattcctggttttatttgttagtgtgtagaaaatgctagacatttcctcaatgtatgtttattattctacttcctaagtaaagctacttttaaaataggtttggttgcttcttgaaagatagtgttacaggaaccctgccaaaagtacatcgaacaggtgcagtttctggacattccttgaagcaatgtggtcatcaaataagtggtaagttgtgaatttcttagctacatttgagttaatattggatctcgcttagaacagcttttgctcaaagtttgtactgctacagctttttggaaggcatcactcataaagataggagatggggcagtattctggacacaaaagagggacccatattcatctggacacttctattgtctttataaatcaacacatacttaatgagcctctattatttatgaggttagcgctcaagtgtaagatttgcagaaaatgaatccaaataattgtgtctcgtttccagataagaatttttaagaaaacacaagggaacatctctctcaagttcacttgagggtaatttttacatcagtgattctcaaccagcagtgattttgtctcttccactggggacatttgacaatgtctggagacatttttggtggctacaactagggaggatgctattagcatttactaagtagaggccagaatgtttgaatgctgaccaacattctacaaggcacagggcagtcgtccacagcaaataattttctggcccaaaacgtcaacagtgctgacatcaagaaactctgtgatataccactaggcccaaattgaagaactgagttctgcaaatcttgctaagaataatacttcctaaaggaaacttgaggactaggatgctagagaactttgattctgacatctgaagctactgatgtcttgggaaacagtttccaatgctatcctaataaatttaagacaaatgaactatttctcaaacatgactgggactgataagaaagtgaaaagtgctgaaaagattcaactgatgggttgtcagaatcttaaaataactgctgttattctatgtatgactatatatcattactattttattttcattatgcacaattaattttgtaggttcaaatttcagatgtttttaaatttgtcatcctttcctccctcattgatatcacctcttcaatacgtacacactttgagcctgctgtttgcattttaaccagttatcaaaggatggcaatgccttcattataaatgtgggcctgacttagccagtataataggtgtagtctacgtgaggtggagtacatttcctattttaaaagatcaatttttatgttaatccaatttggtataaattattcgagtaagtgctatttctgattgttgtatcttgtagcaaaatttaaagaaaaagtaatttgtgcctttctcaatattcctgttattgttcatgtattctaaaactcactgttactcacttagcttgcttttaatgttttttaaagtgaaaaattgttcccaagtacataaaatctctacactcaagaacaattctagtcaaaagcatttagagcttccgtatgaacacttaaagagtttttatttgtaagagtcgcatcccaactcttagcctgttcttttctcacatgcagaaaaataggaaagagacttcgtttccacagtctgcaaattcctgtgtttaagaaccacagtgaataatccacctccctgcccaactcatcgtactgtcatatagttttcctgacagtttgtgtattttctgtctttcccacccttaaatttagttttatgacttcaaccatacttcttaggagtggaaaggtatctgtagtagattatggtttattccacataatcttggggaataaaactttaaaaaagtatacagtttatacttctggttacattacttccttaaccaaaagtctaaccaagaaatttgaatctttaaaaaaaaaagaggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcgtggtggcgcgcgcctgtagtcccagctactcgggaggctgaggcaggagaatggcgtgaacccgggaggcggagcttgcagtgagtcgagatcgcgccactgcgctccagcctgggcgacagagcgagactccgtctcaaaaaaaaaaaaaaaaaaaagagcctaattttgcttcactgtctgtgaaaagaattatctgtatcttttgcatgtaagacaaatctcaatgaaaagggtgcttaaatagaagttaacactattttaaagcaagaatggaagtggtttcatcatgcgtaaacaacaactctccacattttgtaatgattgatctggatgcaatttgtcatcagacaggagaagtcgaaagcaaagaaataacactgggagatagagaagctctttcattcaatgcgaaaggtcaaaggcacatcagtttctttaataatgcaaacctcagcacacattatcagtgtcctcattattattgccttgtttatttcccactgctcattgataatttcaacgtgaaatttacctgtattgctgcatgcatcttgcagtttaagaagtgaagtaacccaatttcaaagctagtgctttagggaaaatattggattgtatttacttcaagcagagttcgataatttatgtacataataaaaattttaaatcccttagttaatatagcagttgccaaaactgggctattatcattctaaactaccaacccaaatggtagtgggtatctaatctacctctagaaagaaaatggactgtatttgctctatgtatttttcttgtacagcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggtgagtacaattcaaggtgtgtgttctttgtattggtgcctccaggatttcactgtattcttcttaacctcttttgttcccaaactaaaaaccaaacagggcttttattctaaccactttcctcatttacttactctattttatttttttatcttttatttatttatttatttattgagatggagtcgcgctctgtcgcccaggctagagtgcagtggcgtaatctcgactcactacaacctccgcttcccgggttcaagcgattctcctgcctcagcctcccgagtagctgggattacaggcgtccgccaccatgcctggctaatttttgtatttttagtagagtcggggttttactatgttggtcaggctggtctcgaactcctgatcttgtgatccacccacctcagcctcccaaagcgctgggattacaggcatgagccactgcgcctcgcccttcattttttaattaaataattcatttaatttcatttgtttctctactcttttcccctggcatgtaattgtaccgcatcttcaaagcctgacatcctcttcccctacttctccaaagctgattcttgcaggtctttcctcaaataccgtcccctccaaaagcccatttctgagcattctcttttaagtcacactcagctctgtttatttcattcatagagctaatcacaatttgatattaacttgtgatttttttccttatttttaaatcttatttttatttgcatagatgtatggggtacaagtgtaattttgttactttgatgtattttacagtggtaaagtctgggcttttggtatatccatcactggagtcatgtacattgtacccactaagctatttttcaacgcccgcccccttcccacctctctgtcaccttcccagtctctactgtctatcgctccatgctctactcaattttggtgtcattttttcctgaagcaaaattttggtgtcattttttctgaagtcattttctgaagtctgtgtcatttttcgctttcctgaagcgaattttggtgtcatttttcctgaagttccgtttgccccacacataggccttgcttatagaatgagggtttagtgtcacggagtctcctgcctcattctcaccctaacttttcctttacccctttgcgaggggaaggatgtccattaggttaataatgcagacccctaacccactcattatcagggtcattgtttttccactgtgcattttaatactaactgttacctgcactgctccctgcccctcaaagtgcagaaagcaaagtaacctcttttcttcccattcaggaacaattgcctattaaagtacagtcccggaggaacacctaccgctataaaggtgctgagtaacgtggaatctggattctcactgaagccctgtgccctttcagaaattggtaattgtaggactacttcactttgtgattgtggtaggtggaataggagcccccagagacgtccctgtgctgagccctgggacctgtgcgtgtgttcccatagctggcaaaagcgtttctgtcaatggcatgcagttacgggcttcgagatggggagtttactctggattttctgaatgggcccaatgtactcacagggttgagtgctcacaaggctcataagaaaaagagagaggcggaaggctcagagccagagagagaggtttgaaggtattacactgctggctttgaagatgaaggtccgtgagccaaggaatgcaggcggcctctagaagttgaaaagggcgaggaaagagtttccctgtggagcgtcctggaggaagaagccctgctgatgtcttgattttagcccagtaagacccaatctctagaacagtaagataattaatttgtgttgtttttaaccactaagtttgtggttatgcccctagagcagcagttataggaaactagtacagtgatactgttagagttataggacagtgatataggacagtgatactgttatagttataggaaactagtacagtgatactgttagagttataggacagtgatataggacagtgatattgttatagttataggaaactagtacagtgatactgttagagttataggtacagtgatattgttatagttataggaaactagtacagtgatactgttacaggtacagtgatataggacagtgatactgttataggaaactagtacagtgatactgttagagttataggtacagtgacataggacagtgatactgttatagttataggaaactagtacagtgatactgttagagttataggtagagtgatataggacagtgatactgttatagttatagaaaactagtacagtgatactgttatagttataggacagtgatataggacagtgatattgttatagttataggaaactagtacagtgatactgttagagttataggtacagtgatataggacagtgatattgttatagttataggaaactagtacagtgatactgttagagttataggtacagtgatattgttatagttataggaaactagtacagtgatactgttataggtacagtgatataggacagtgatactgttataggaaactagtacagtgatactgttagagttataggtacagtgacataggacagtgatactgttatagttataggaaactagtacagtgatactgttagagttataggtacagtgatataggacagtgatactgttatagttataggaaactagtacagtgatactgttatagttataggacagtgatattgttatagttataggaaactagtacagtgatactgttagagttataggtacagtgatataggacagtgatattgttatagttataggaaactagtacagtgatactgttatagttataggacagtgatataggacagtgatattgttatagttataggaaactagtacggtgatactgttatagttataggtacagtgatattgttatagttataggaaactagtacagtgatactgttagagttataggtacagtgatataggacagtgatattgttatagttataggaaactagtacagtgatactgttatagttgtaggacagtgatattgttatagttataggaaactagtacagtgatactgttagagttataggtacagtgatataggacagtgatactgttatagttataggacagtgatattcttatagttaccgtggtatagttatagttaaaggtacagtgatattgttatagttataggacagtgatattgttatagttataggacagtgatgtagttacagtgatataggtacagtgatattgttatagttataggacagtgatatagttataggacagtgatattgttacagttataggtacagtgacgttgtaatagttataggacagtgatattgttatagttataggtacagtgatgttgtagcaaaactgtaaggtcattccttggttgtgtccctatctagtgaaatgactctaccaggggtagggaaataaaactctgtcgtttcacacataaaggtaatttcaatggaattatccagaaaattgccatgacattccacctcatttagcatgtcaggatgttaatgacaagatgttactaaaagcaaatcccttacggccagttttccgcagtactgggtgctggctctgtgcctggccctgtattgggtgctgggctaggatttccctgtggaagattgggaaggttggttacaaggtggctattttcctgtctcctctttgcgacagcacaccttctccatggtgtgtgccaggttcacgtgtactggtgatttaattttaacgttcatattatttttttctgggagagtttttgaaggctgccaggaggcaggactcgatgcaaacatgctccattctgtacccagccctgttgctggaaggatttgctgcacttacccagggaacaggcaagctcgtgctgtggctctgggctgtcacagctgctgtccacacctgggagagcaccctggatggctcatctgtgtacttgctttcttgttaaattgcagtgagttcacatgtgatttaatcggatcaaatggcctttacagactgataaaaatatggctgtttcaggtggtgttttgagctgctaagggcgtggcttttcactgagtacgtggtccccgttcctcagggaacacccagtagccacatgcctcctaaacctagagtagggctgtctcctggcctaactgcccaaatgagattcataagttagggatgatctgtagttatcactacagatttgtccttggtttcaccaaggattttcctaattttacaaacaaaacccctaaggctcctggaaggagggtagaagtgaaggtgctccgggggcaacacagctgatgagctgaaccagaactcgacccttgggtcacacacatttcacagtgctcactccaccttttgtttttttaatggatttaatggtgttttaaagcctcctgcctctcaacacatatgaattcattatatttacagatttccttctcttgtggtccatcttcctgcatagatcttgagagatgtcaggctaaccacgtttcctcagttaatttaacaaaaccatttgcaactctgacatggaaaattcctaccatgtgacttattaatttatcaattgagatggtacacatattttcaagccaaaaggaggaaaacataaattggaaaaaaaaggtttttttatttttatcacctctggggaagaaagtctgataaacgaagctggttgataaaattgcaattaggggaagcaacatcatggtttctgttcggaggctaaccagatggcatacttgaaatagagaatgtcctagaaatcaactggttgcttggccaaaatatctataaatagtgcccaacatattagataggaaaagcaaagtaaaaacaattttaacaggttaggacattgggctgaagtattgcatatatttaatgtcatgtgcgtccgtgtgaagagaccactaaacaggctttgtgtgagcaagaaagctttttaatcacctgggtgcaggcaggctgagtccgaaaagagagtcagtgaagggagatggggtggggacgttttataggatttgggtaggtagtggaaaattacagtcaaagggggttgttctctggcgggcagcggtggggggtcacaaggtgctcagtgggggagcttctgagccaggagaaggaatttcacaaggtaacgtcatcagttaaggcaggaaccggccattttcacttcttttgtctttcttcagttacttcaggtcatctagatgtatacgtgcaggcctgggcccagaggcctgacattcctgtcttcttatattaataagaaaaagaaaacgaaatagtggtaaagtgttggggtggcgaaagtttttgggggtggtatggagagataatgggcgatgtttctcagggctgcttcgagcgggattaggggcggcgtgggaacctacagtgggagagatgaagctgaaggaatattttatggtaaggggtgatattgtggggttgttagaagcagcatttgtcatatagaatgattggtgatggcctggatatggttttgtgtgaaatgagaaactaaatggaagacacaaggtctgaataagagaaggagaaaaacaggtgttaaaggactaagaattgggaggacccaggacatctaattagagagtgcctaagggggttcagtgtaattacttgcttggttggtgagtttttgggctctatccttgacagagtcctcctttttaagttggaggctgagcttggtgaggtgtgtttttaaaagaccattagtctgttctacctttcctgaagattgaggatggtgaggggtatgaaggttttactgaataccaagagcctgagaaactgcttgggtgatttgactaataaaggccggtctgttatcggattgtatagagatggaaaggccaaactgaggaattatgtctgacagaagggaagaaatgaccacggtggccttctcagaccctgtgggaaaggcctctacccatccagtgaaagtgtctacccagaccaagaggtattttagtttcctgactccgggtatgtgagtaaagtcaatctgccagtcctgggcgggggcaaatccccgagcttgatgtgtagggaagggagggggcctgagcaatccctgaggaggagtggagtagcagatggaacactgagcagttattttttgaggatagatttttacgacggaaaggaaaagtgaggttttaagaggtgggttagtggcttgtaacttacatggaagagtttatgaaatgatgacagaatagaatgggcctgtgaggctggaggagatattttccttggtccaagaattatttgccttgtgtgggaagagattgataggtggaagtttcaatgggggagtagatgggagtgacagatgaggaagaaaaaaactggctgtgagggatagaagttggaatgctcgctgcttttttagctaccttatcagcataggcattgtcctgagcagtgggatctgatgccttttggtggcccttgcagtgaatggcttcagcttcctttggaagtaaagtggccttgagaggagtttttattaaagaggcattaagatggagaacccttgtgtagtgaggaaacctccttcagcccatataaccgcatggtggtgcagaatatggaaggcatatttagagtcagtataaatattgacacgtagtccctttgcaagagtgagggcctgagttaaggcaatgagttcagcttgctgagaggtagtggagcggggcagagcagtagcctcagtgatagatgtggaagatactacagcatagcctgcctttgctggtgagtggtgattaggcctggtggaactgccatcaataaaccaagtgtgatcagggtaaggaacaggaaagaaggaaatatggggaaatggagtggatgtcaggtggatcagagagatacagtcatgggggtgggggccagcctaaaacagtaaggtcaagttgtttgaacagaaaggctacagggcgtggtcctggctcttgtgtaagaattttgactgcgcagccctgcacttcggctgtgtgtaatgaaaagggttgggatgagttagggagagctagtgtgggagcagtttctagggctgtttttaaggaatggcaagaggagtggctaaaggatttaggatctttggggtcagctagctttgcttttgtgagtttatataatggtttagtcaggatggtaaaacttagtatccaaaggcggaagtacttaaccatacctaggaagaaaaggagttgttttgtagaaggggttggggtttgggagatgagccagacacaatcagcagggagagcacatgtgttttcatgaagaattatgccgagataggtaatggatgaggaagaaatttgggcttgactgaagtaatgggggctgtcctcgaagccttgtggcagtacagcccaagtaagttgctgaggctgacgggtgtcagggtcagtccaagtgaaagcgaagagaggctgggatgaagggtgcaaaggaatagtaaagaaagcatgtttgagatccagaacagaataatgggttgtggagggaggtattgaggataggagagtatatggctttggtaccatggggtgaataggcaagacaatttggttaatgaggcacagatcctgaactaacctgtaaggcttgtccggtttttggacaggtaaaatgggggaattgtaaggagagtttataggcttcaaaaggccacgctgtaacaggtgagtgataacaggctttaatccttttaaagcatgctgtgggatgggatattggcattgagcggggtaagtgtgattaggttttaatgggatggtaaggggtgcacgataggttgccaaggagggagcagaggtgtcctatacttgtggattaaggtggggacacacaaggggaggatgtgaaggaggctttgaactggggaaagggtggcattgaggtgtggctgtggcctaagaacagtcagggaagcggataattgagttaaaatgcctcgacctagtaagggagctgggcaggtggtgataactaaaaaggagtgcataaaagaatgttgtccaagttggcaccagagttggggagttttaagaggtttagaagcctggcggtcaatacctacaacagttatggaggcaagggaaacaggcccttgaaaagaacgtaatgtggagtgggtagcctctgtattaattaagaaggggatggatttaccctccactgtaagagttacctaaagcatctgtgatggtccaggaggcttctaaggtgatcgggcagcgtcagtcttcagccgctaagccaagaagatctgggaagcagtcagtcagagagccttgggccagagttccaggggctctgggagtggcagccaggccagttagacagtccgatttctagtggggtcccacacagatgagacacagcttaggaggaatcccaggctgcgggcattccttggcccattggccagatttctggcacttgaaacaagatcctgatggaggaggtcctgtaggaatgcttgaccactgcagtttaggcattttgaagtttttgtgtgtgctggagatgtggctgggttttgtctcacagcagaggcaaggaatcgcaactcagaaatacattgctacttggctgcctctattattgtacatcttgaaggcgaggttaattaagtcctcttgtggggtttgagggctggaatctaatttttggagtttttttttgtttgttttttggttttttttttttaatgtcaggagctgactgggtgataaaatgcatattgagaataagaggccttctgacccttctgggtctagggctgtaaagcgtctcagggttgctgccaaacgggccatgaactgggctgggtttttcatatttgatgaaaaagagcctaaacgctaactgatttgggagaggtcggataaataaaaaggaacattaatcttgactatgcctttagctccaaccacctctttaagaggaaattgttgggcaggtgggggagggctagtcgtggaatgaaactgtaagctggaccgggtgtgaggaggggaggtgatagaaggattatagggtggaggagcagaggctgaggaagaattgggatctggcttggcctggcaaggagcagcctggggaggaggggagaggtcagatgggtccatagaaaaggaggattggaaagactcagcaacacttggggttgggattgagaggacagatgggttgggattgaggggacagatgggagggaaagaaggaagatttgggacaagttgcattgggaacagagactagggagggaccaatgtgtaaaagaatgcctggacgtcaggcacctcagaccgtttgcccattttatgacaagaattatctagatcttgtaggatggaaaaatcgaaagtgccgttttctggctatttggaaccattgtcgagtttgtattggggttaagcagcattgcagaagaaaataaggcatttaggttttaggtcaggtgtgagttgaagaggttttaagttcttgagaacataggctaagggagaagaaggaggaatggagggtggaaagttgcctatagtgaaggaggcaagcccagagaaaagagagggtagagacatggagagaaggggtgggggggtgcttgcccccaggaaagtggttcttgccactaagggtgaaggatcaaggcaggcattcgcgcggtgatcagatacctctgaaacgtgggtgaataatcaagcaggtgtccctgcagtgattaaacagcaaggaaagactatcttcccaagtccatgaccagtgccagagttttgggttcatggataaaacgcgtctcctctgtctctaccagaaaatgaaaggaattgaaattaagagaagggagagattgaaggatggcgccaagattgaaaggaaaaagaggttgagggatagggagagaggttggataagagagtaaaaagaggctgcttacccaatttaaaatcggtgagatgttccttgggcttgttggtctgaggaccagaggtcatgggtggatctttctcatggagcaaagagcagggggacaggggattgatttcccaagggaggtcccctgatctgagtcacagcaccaaatatcacgtgtgtccatgcgaagagaccaccaaacaggctttgtgtgagcaagaaagctttttaatcacctgggtgcaggcgggctgagtccaaaaagagagtcagtgaagggagataggggtggggacgttttataggatttgggtaggtagtggaaaattacagtcaaagggggttgttctctggcgggcaggggtggggggtcacaaggtgctcagtgggggagcttctgagccaggagaaggaatttcacaaggtaacgtcatcagttaaggcaggaaccggccattttcacttcttttgtcattcttcagttacttcaggccatctggatgtatgcatgtaggcttgggcccagaggcctgacatttaacatggataaatgtaaagttcttagaatcatacatacactttggaaaagatggggcttaatcgcactttataagacttgaaggatgtttgagaatcactatgaaactgctgaaaataccaagaaaatttaattcttatgtatataaataatgtgtctgttttacatgaatcccttctacaagcttggtatttaatatggcatatattgttttttcatagtagatttaaaatttttgatatctaatttagataacataaaattaaccctttgaaagtgtacaactccgtggtttttagtatatccacctgattgcacaacgatcaccactgtctagttccagaacatttttatcaccacaaaagaaaggctgtatccaggccgggcacggtggctcacgcctgtaatcccagcactttgggaggccgaggcgggcggatcacggggtcaggagattgaaaccatcctgggtaacacggtgaagccctatctgtactaaagatacaaaaaaattagctgggcatgatggcagatgcctgtagtcccagctactcaggaggctgaggcaggagaatggcctgaacccaggaagcggagcttgcagtgagccaagattgcgccactgcactccagcctgggcgacagagcaagactccatctcacaaaaaaataataaaaataaaataaaaaaaaaaaagaaaggctgtctttctcctttcccattggccgtctttctccattccctactcctccaatcccctggcaaccactaaatctactttccatgtctgtggacttgactcttcgggacattttacataaatggaatcatgcaatgcagcacattttgcatctggcttttttcacctggcgtgttttcaaggctcattcgtattctagcatatatcaatactttgttcctatttaggactaaataagattctattgtatgaataaaacatattttgtttatatacttagtttgatgaacatttgagttgtttctggatttttttttttttttttttgcctcttatgaataatgctgctatggacaacagtttttgggtaggcatgcattttaaattctcttatgtatatacttaggattaaaattgctggatcacagagtaactccatgtttaactttttgatgaattgccaaactgtttttgagagcagctacacaatgttacattcttaccagcaacaattgagggcttcagtctctctacaaccttaacaacacttgttattgtctttgtaattattgcctttctaggcagtgtgaagtggtgtctcactgtggttttgatatgcatttccctaatgactaacaatgttgtgtatcttttcgtgtgctcattttcaatttgaatacattctttgggaaaatctctgtttaaatcttttggccattaaaaataattgggttattttcattgttgagttgtatgaactctttatatactctggatactacactcttatgacatatattattttcaaaaattttctgtgcatctgcaggtcatcttttcactttactgatggtgttctttgaagcaccaaagtttttaaacttgatgaaatccagtctggctttattcttgcacgtgctttacctaaaacgccaaaacctaattcatggttttgaagatttttgcttatgatttgttcttagaggtttatagttttagctcttacatttaggcatttgatgcattttaaattaaattttgtatatggtgtaaagtagcaatccaacttaattcttgcatgtgggtattcagttattccattgtcttgaaacccttttcaaaatcaattgtctataaatgtaagagtttatttttggaccatcagttctatcctgttgacctatatatgcctatcctaatgccagttacacacagtcttgattaccataactttgcagtaagttttgaactcagacagtctgagtgcttttattttgtcctttttcaagattaatttggttattccggatcttttgcatttccatatgaattttaggatggttgtcaatttctgcaatagaaaagcagcaggattttgatagagagtgcattgaatctgtagaccaatgagtatcaatggaattatgtgttatcaaatttagtaaactacataaacgatatgtacacaactaaaacaaaactaagatataagatcatattaatgtaatgataataaaagtggattgtctcctgttctaattttaataggcacaaggcatttttgttaatcacttcttattaaagaattttttataatattcaggaaaatacaacaaaaaaacccttacattcctaaggcctcagagtcagagtaatataaaggaaatgtaaacacatgctgagtaatgcaagcatttggcaatggtggtgactggagctgggagcacagcttttatttctctgaaataggaatttgccccttagagttagaccaattttgccttcctctaaatggcaaacagtttggagatactttaaaggacattttttcacttaggatgtttagtactatgaataataaatagtcacaatttccttaactatggtgacaaaatacaagcaaatttagcctcatgtcatttcctaaggaacatcttctctctgtgagttcacaggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaaggcgagtatgcatggaaaatcgcatcacaaaggcgagtatgcatggggagcacttgctgctgtactttcatcacttttatagtctgagttcttaaaagtttcgttcatttccctcaaaacacttgaacctgcagtttcagtaggtactgttctgccaggtgcagattagttaagagattagcagacttctctgcctatcttctcttactttaaaacaaatgttaccattgaatcaaggaagcaatagccatgagaaaaaagaaggatctgacgcctttgaatgaagattcaaaacatgatcttcatgttttgtattagcttggagtaaaatccacttgctggcaatatagcccttaagcttgttgcctcttctctttgtttcagaaactagagccctgtttattctgatcaaggctctggcccactgtctttatctcagataacccaccctcttctgcacacagcatggagctaagagaagggtgtctagttatgtaatatcatcggcagcataaattcccagaatttgttctttgatttttttgtttgtttttccagttagaaggtggaacttcatcattgtcctcttttcaggttgtctgtgcctattagttttctccagagggagaggtggcttgatttacatttaatctctgcaatttattagagtcctgtagttggatttactttgaagagagtttcccagaagaataaaatttgctgcgttgctttttgggtgtgagctgcttttgtatttgcctaatgcctttaatgcaaatttctttctttctctcttgcttttttttaaaaaaaatagaaatgtttgtcttcttaaaacatctgaaagtggcacaccaagttcctctactcctcaagaaaacaccatatctggatatagccttttaacctgcaaaagaactttacctggtaatgtgatttgataataatattacataaaatgtaacctatttcatgacttttaacagcaacagtgatgaaacaatcctcaaggtaacagaaacttgtgtaaatgtcgttcattgcttttcccatctgatatctttttgtgtttataattgacacagaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtaaaggaaattttatttttcaaagacagttgacatgaccatttcatattctctttccccctgtgaaggcttactctttctactgttcatttcatctaggtgtaagtgtttcttaagattatctatggatggttctccaactaggattgcgtatgggacacaagggagctctggttactctttgagattgtgtaacactggggacaactctggtgagtaacctcactttttcgtggacctgtcagggatgtctgtcatgttgatagtttgcttagtcttaaggaattatgtgtcttgttctccttggttagaagggactttgattcacttctaattccaaccattagcgtcaacgctctcttttcagtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggtaagtgttggatgcatctcatccagagtcttatcttggcttttcattttgaaggatctatgatcagctgcttcaccgccatgtgactttatgaatagagacgtgttaaagcggggatggtattcacaacatttaacttatagggtccaagcactgaccaacctgaccattagaacagagtgtggtctctgtacagggcagatggcgctgagtgggtattctccacagaaagagaaacgaagacagtaccccactcctccaacccaccacccaccaccaatcccaccaccaattccaccaccaatcctgccacccaccaccaatctcaccaccaatcccaccaccaatcctaccacccaccatcaatctcagcaccaatcccaccaccaatcccaccaccaatcccaccacctaccccaccaccaatcccgccacccacgaccaatcccaccaccgatcccgccaccaatcccaccaccaatcccaccacctaccccaccaccaatcccgccacccacgaccaatcccaccaccgatcccgccaccaaccaccaatcccaccaccaatcccaccaccaatccctgatgtgttcttcaaagacttatttgtcaggcccatagaaatgttacttcttgctctttgattcataaatatactaagtcataataatttttaaaagtgagagtttcgtactctgtatatttcaatgtatataatttgatctatttcaatttattggtcaaatagtagacatgttaggtaagtcttaaaatactgaggctttggagttagacagaacatggcttaagtgacagctttgctgcttattagaggtgtggccctagaagatttgtaaatccctctgagctttatttgatctaaaatatgaatagtaatagtcccgaatttgtaacgttgttgggaagattaagtgacacatttaaaatgcttagtactgtgtgtagaacataaacacttcaaaaaatgtaaactgtgatttctatattcaataagaaatgtagaaatggacaaagcatataaaaagcaaaagaaatactagaagacacttgatttttctcaaaaataaacacaccaagtatttttgttttagtgaaattcatgcttacatgctgtatactaggattgaacatactgccaccaaaatatagcagtcggtggtacatgtgggtggagcaagacccctccaccttgtcatcgtgtgaaggggctctgccatacatgaccttgcatgtgactttaaggtggttggcctggaagaaaagtcccaagatgggaaatagtaggtgtcttttttactaaatgcactccaatttgggaccaaaaattttcattcttgaaggctcagtattgtgagtttataagagataatagacataaaagtgtaatgatttcattgcaaataaaaaaaggcccctttgcacctgatatctccatcatttttctagaattttgtgcacacatgccttgcactacttggtgatgataaagatttccagatctttgcacagaataaggctttgctttagatcagaattttggatgtacttagtatacattcatcttttaaataatctatttacattttcatactttccaaaatacagatatattttattttatttatatatttatttaatttattttttgagatggagtctctctctgttgcccagagtagagtgcagtggcacaatcttggttcactgcagcctctgcctcccgggttcaagcgattctcctgcctcagcctcctgagtagctgggattacaggcgcgcgccacacctggctaatttttgtatttttagtagagacgaggtttcatcatgttggtcaggctggtctcgaactcctggcctcaagggatccacccacctcggcctcccgaagtgctgggattacaggtgtgggccactgtgcccagctgtatagagatattttaaacaacactaaagtcctcctactttgactaattagaagagcattagaagatcagcctgacttcttgacagttctgaatttagtggagcaatgaggttcagctttggtgaatgagcttaatttttccatgataaactgctagtttcttcccactacagtgtctctcaaaaatgggacagcaacattctttttgttttcacttgcagtaagcatgatgcaattacataaatgtacacttttcaatttgttaaatagaatcttcagagattcactactgccgctattggtgatgaaaaattaccagaaggaggaattaggtaggagaaaatgtgtcctatgtatttccttcccagttctttgaaagagagtgataggaaaaaggaacactattgaaggaaggactgcccagtttcaaacaggtatttatttttctctcctaggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactggtatgtagcatatgtaagaaggtggagagcagaattgcgctggttgatattttcatatcagtttgaacaagagggcagacctagagagactgtcgtcgttttctgactggtggagttgagggaaacgtgagggttgctgggaagtgaagaccccgcgacttgccgtgaaatctcttctacttaaagagcaagacatgtgaattaattctttcagggagggatacaactgcatgcaggtgatggaaataatgggcgtgggaaatgtctgtgccgtctgagaggcactgggcttgctttgacaagagtagcagaactgtcattgctttgggcttagggatattcgaatgtgtgagggcaagtgggatcagatatctacttccaggtataatttgggtaggaaagagactcatgcagaaagaagccctggaaggccagagcatcgtggtcagaggtgttgcctttggagggtcattgctgccaggagccgaatacccactgtatccaataacattcatggtcaggaatggtggctcacacctgtaatcccaacactttgggatgcccaggtgggaggattgcttgaggccaggagtttgagaccagcctgggcaacacagtgagaccccgtctctacataaaattagaaaaaaacaattaactgggtgtggtggtgtgcacctgtagtcccagctagtcaagaggctgagacaagaggatctcttgagcccaggagctcaaggctgtagtgagccaagatcgtgccactgcacacaaacaattatgtgacctcgggcaagttgctttacctctttacacctcttaatttccttatctgtaaaatgaggatgataatttcttcctgggtctgttgtaataattaatacatcaaagcacttcatgtctggaacagtgaagataccctgctatgactattaaggatagtatacatggaataagacacaggaacttctaaatgcttttgaccatagatttaggttctgagttttaagaatttaactcaggaaattgtaacaccaaaaatgtcatgtgaaaaatggtggtgacaaattttcttgaatcattagccttagaggttgggcagaaagcaaaaaattattcttgatgctactctatagaaagagaagacagaaaaagagaaagatgtatttttaaagtctatatccataactttatttgaccaaactctaatttaaaaattatgtttcagaattccaaaaaccaatatgcctaccttccaaaggtgacacaagcacaatttataccaactgttgggtaaccggatggggcttctcgaaggagaaaggtaagcatgacgctttaaatattgcttctagagtaagtctcacatgttgaaatacatggagtgggtcgttttaatcggtttctgtctgaaattatatctaaactctttatctttcctatctatttattcccaaatatttattcagttattcttaaaaaatgtatttttgctttggcttgaaaaaaaattttagggagacttttaagcatcttacttcattataaagatcagttgcttgactttgcatgaagcagattgggcccttctagggctgacaagcccgtgcaagaccacccgctcctcagtgttagtagcgttcccgtctcccaaaaccatgttctcccttgatgctaatggccgggagcacaggcaggtgtgtcgtctcactatggagaataatatttgtgtcattctttacagaagaaggtagcttgccaaactgtctccatctttcccgattcagtcttttgttcaagtaattcacatttttagattttttattggtaatctgagacaagaagaaatttaaagtaatcttcactaagccatgaaagctcccaacattgttctccatgagagatgctggcctgcatttattcaaaaacaaaagacccctctgttgccaaagctcggagggcttttcagaaacgatatagttgtaaattataattttgaatatataaagcaaaaaaatgaaaagtgagaacttccaggctttggattgttgtaggtgataaatataaaatgggatttctggggggctgctactgagatgaggggatggcagaaaacatggaagcaaggtctctggtcagcccagggtgctgggcttgtcccaacaccacgtaggcaataagaggacagtacagggtgccgtctctctccctcttcctctctctgtctctctctctctgtgtgtgtgtgtgtgtgtgtgtgtaacactaccttcccaatttttactgtctatttgtattcaaagataaggtccttatgaaaaatacactgctctgattcactttaaaacttatttccatatttattatttattgtgggaataataatattcccaatattattatttattatttaagttattattattaacttccctctgaggttatatattggttactcacaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaaggtaactcatgagattatgaaaaacacaataggctgcttgagaaaattcatttcaaaatatattttccaatagcataattcaatcatagtttttaaaaaaattcagagacaaatgatctgataaattgataagcaacttttaacaaattgaatatacataatatatatttatattatttatgatatatgtcacaatctatgcatgtgctatttaagaggggcaaatatacatgcaataattgtgctagaatataaaaacattagacttcatcattgggatgatgatatcaagatttctttgttagatttatttcagatagaaaaggggatacgaaaaatgcaggcacatgagatacttggagaactttaagaaagagtgagtgtgtgtgtgtgtgtgtgtgtgtgtgtgtgtgtgtctggcaagcaaggtcttgcacacacacagcactttgggaggccaatgcaggtggatcacttgagcctaggaatttgagaccagtctgggcaatgtgatgaaacccatctctacaaaaaaatatgaaagtatctgtgtgtgtgtgttgctgtgtagtggactacagaactttagaggcagtcacttatttgaatcccattgtcgtaactttctactattttatttttccactgtgactcagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcacgattagcaagtgttttcttctggttgtgaaacagaactgaaagtaagtggttgaggttccagcacagttcctgggatccctctaattgcactgcttcctctggaactcagtatatctcaaagatgtaatttcctctccgtgctgcacctggtcggccactgaaacccactattgcctgcttcacgtgtggcaaagagctagcgggcttgggttttgttctgccgagaggaagggagaacacccacttttataagaaagagatgggttacctgaacccatgggcacctttgcctcttggcctcctaactttgctaccagggcatggctaggagggtccaggctgcgcgtgctgaggagctcgaggggctgcagcattgcacagccttcatggcaggcaaggaatctgctttgcaaggggcattagccctggaggctcagtggatatgggctattgcaatagtaattcaaggagcatttttaggcctggcgtggtggctcacgcctgtaattccaacagtttaggagatcaaggcaggtggatcacttgagcataggagttcgagactagcctggccaatgtgacgaaaccccatctccacaaaaattagctgggcatggtggtgcgcacctgtaatcccagctcccccagaagctgaggcaggaggaccgcttgagcccggggatgtcgtggctgcagtgagctgagatggcaccactgcatcactgcattccagcctgggcaacagagtgagactgtctcaaaaaaaggaagcattgttaggtataaattattattattattattattagtagtagtagtagtagtagtagtactgagacggagtcttgctctgttgcccaggctggagtgcagtggtgcaatcttggctcactgcaatctctgcctcccgggttcacgccattctcctgcctcagcctccggagtagctgggactacaggcacccgccactgtgcttggctaattttttgtatttttagtagagacgggtttcaccatgttagccagaatggtctcgatctgctgaccttgtgatccacccgcctcggcctcccaaagtgctgggattacaggcttgagccaccacacccagccctgttaggtataaattatttcataaaattcagacttgtaaatttatggtagcctttggaatgggtgatagatgtcctatgccacacaaattcctcacatgccgaggctcaccgtaactgataccagctcgcttgattcagttcagttaaactgaacaacatttacacagaattggcgatttacaaaatcttatgtaagttaagtagaaaaacagaaaaaagttttctgaaagagtttgggtttttccttcaatgctcaagacagaggtccccaacctttttggcaccagggaccagttttgtggaagacagtttttccatggaccagcatggtggtgggggatgattctggaatgattcaagtgcatgacatttattatgcactttatttctattattactacattgtaatatataatgaaataattatgcaactcaccataatgtagaatcagtgggagctctgagcttgttttcctgcaactagacagtcccatctgagggtgatgggagacagtgacagatcatcaggcattagattctcataaggagcctagatccctcacatgtgcagttcataacagggtttgagctcctatgagagtctcatgctgctgcggatctggcaggaggcagagctcaggcggttatgcttgctggcctgccactcacctcctgctgtgcggcctggctgctaacaggccatggaccaggtactgttctgggccccgggggttgggaacccctgctcagagacacaccgggtggtaggaggagctaaaggtggagagggtgaaggaaaatatgaggtctgggctatccacaaaccagatagcaggaaactgaagagttaaacatttacttcagaattgaatggcttttgtaaaatctggctagattccatgaaacgattttaaaaatgcactatttaaattttgcctttgcatgcgatgaagacattagtctttgttcatgtggatgtttttttatgtttaaaagggaaaaaatggtttgcaatgaaacttttatctcagtctttgagtattgatcatggggtgttggaacaggactttggaatgcttgcagggtaaacctttggcctctgttagtcagggaatgacctagtttggcaaaacagaggagagttttgaaatatggaactttcccgaggcatacattgtcattttaaagtggtcaatcaaagcccagtaggactgggctggtgtcttggtgactcactgtgtgctcatatacaggggtaactgaggagcccttcacacaggtctagcctcgtgggactaaaaagtgtgacatgggctaggaaaatgcgaggctgggatgccttcactcccatgaggaagcgtgacgggaggaggcgtgggccactggcagttctacttcacaaaggctgctggcagtgtcaatcctgcaagctggccttgccctcctgtggcggcagtgtacacgtggcatgcaagcacatgcacaagccacctggctccaaggtcagccaagggctccaacatctgtctcagtccc

SEQ ID NO: 11 - DNA, 2472 bp, mus musculus
agaccgccctcggtgccatattcagagggcttgaagaccatcttcatgtgaagactccctctcctccagaaccacaacgtgaccatccttccaggatgattttattcaaccgagtgggttattttgtttccttgtttgctaccgtctcctgtgggtgtatgactcaactgtataaaaataccttcttcagaggtggggatctagctgccatctacaccccagatgcccagtactgtcagaagatgtgcacttttcaccccaggtgcctgctgttcagctttctcgccgtgactccacccaaagagacaaataaacggtttggttgcttcatgaaagagagcattacagggactttgccaagaatacaccggacaggggccatttctggtcattctttaaagcagtgtggccatcaaataagtgcttgccaccgagacatatacaaaggacttgatatgagagggtccaactttaatatctctaagaccgacaatattgaagaatgccagaaactgtgcacaaataattttcactgccaatttttcacatatgctacaagtgcattttacagaccagagtaccggaagaagtgcctgctgaagcacagtgcaagcggaacacccaccagcataaagtcagcggacaacctggtgtctggattctcactgaagtcctgtgcgctttcggagataggttgccccatggatattttccagcactctgcctttgcagacctgaatgtaagccaggtcatcacccccgatgcctttgtgtgtcgcaccatctgcaccttccatcccaactgccttttcttcacgttctacacgaatgaatgggagacagaatcacagagaaatgtttgttttcttaagacgtctaaaagtggaagaccaagtccccctattcctcaagaaaacgctatatctggatatagtctcctcacctgcagaaaaactcgccctgaaccctgccattccaaaatttactctggagttgactttgaaggggaagaactgaatgtgaccttcgtgcaaggagcagatgtctgccaagagacttgtacaaagacaatccgctgccagttttttatttactccttactcccccaagactgcaaggaggaggggtgtaaatgttccttaaggttatccacagatggctccccaactaggatcacctatggcatgcaggggagctccggttattctctgagattgtgtaaacttgtggacagccctgactgtacaacaaaaataaatgcacgtattgtgggaggaacaaacgcttctttaggggagtggccatggcaggtcagcctgcaagtgaagctggtatctcagacccatttgtgtggagggtccatcattggtcgccaatgggtactgacagctgcccattgctttgatggaattccctatccagatgtgtggcgtatatatggcggaattcttagtctgtccgagattacgaaagaaacgccttcctcgagaataaaggagcttattattcatcaggaatacaaagtctcagaaggcaattatgatattgccttaataaagcttcagacgcccctgaattatactgaattccaaaaaccaatatgcctgccttccaaagctgacacaaatacaatttataccaactgttgggtgactggatggggctacacgaaggaacaaggtgaaacgcaaaatattctacaaaaggctactattcctttggtaccaaatgaagaatgccagaaaaaatacagagattatgttataaacaagcagatgatctgtgctggctacaaagaaggcggaacagacgcttgtaagggagattccggtggccccttagtctgtaaacacagtggacggtggcagttggtgggtatcaccagctggggtgaaggctgcgcccgcaaggaccaaccaggagtctacaccaaagtttctgagtacatggactggatattggagaagacacagagcagtgatgtaagagctctggagacatcttcagcctgaggaggctgggtaccaaggaggaagaacccagctggctttaccacctgccctcaaggcaaactagagctccaggattctcggctgtaaaatgttgataatggtgtctacctcacatccgtatcattggattgaaaattcaagtgtagatatagttgctgaagacagcgttttgctcaagtgtgtttcctgccttgagtcacaggagctccaatgggagcattacaaagatcaccaagcttgttaggaaagagaatgatcaaagggttttattaggtaatgaaatgtctagatgtgatgcaattgaaaaaaagaccccagattctagcacagtccttgggaccattctcatgtaactgttgactctggacctcagcagatctcagagttacctgtccacttctgacatttgtttattagagcctgatgctattctttcaagtggagcaaaaaaaaaaaaaaa

SEQ ID NO: 12 - DNA, 260 bp, mus musculus
gagtgtaaacactggagccaagcaaagaccgccctcggtgccatattcagaggggttgaagaacatcttcatgtgaagaatccctctcctccagaagcacaacgtgaccatccttccaggatgaatttattcgaccgagtgggttattttgtttccttgtttggtactgtctcctgtgggtgtatgagtggactgttaaataatacctctgcagaggtggggatctagttggcatctagacccctgaggacgagtagtga

SEQ ID NO: 13 - DNA, 30000 bp, mus musculus
atgagaagttattttaaatttaattttttaaagtttatttattcaccccttgccacgctctccagtcgagtcagtttgacaagcagaagcttggaagctggccgtgaggaaaagagtttcatggaagctccctcctggagtctggcactctctttaatctctttaacccatacattaattttccactcccatgttagtctagtgtatggatccacgtgccctctattaagcattaccctattataagtgccatttaagattgaattctgacatagctaaagcctctcccagtgttccaagatcccagtttacagcaaggtagtttaacctattcagtaactaattaagcattacaatagacagagccattaactcagttgtctgcagaaagagcctgggaatctcactgagatagaaatctttactacaggctacattccatgccaagagcaagttgatatactatactgatatatggggaattcttcagacaagataagattttacaagacctaggaatttaggggtccatgacactacattattcttgaggcctgtcaagagttaaaaccccctggtgctattaacactaaagtgtgaaactcttgcctggcattagcctgatcctaggcagggctggtaatttctattgtaaacatttatctagttcctgcaaattcctttcttgcttgtatctggtaaatttcagtgtaccttgtcttattgtgatttgtagctcctgataattcgttgtaatataaaatagtctaatgttcgaccagagattacattcagattcaacacctctcttgtgtgcatctgtttgtcaatttaatcctaagctttgcccacctactctagagacccgttctacacagacacagggacccagagggtctgcagcaacctcttgcatggttatgtgtgcacacacagaagaagtataggtgtggtggtcaaaggacacttttagggggttgccttactccctccactgtgcaggttctggggatagaactccagtcattaggcttgacagtaaatgcctttgaccccctgagatatcctgcaagctccaccatgattttaggctttaaaaacatgcaaacctattagtcatttatctcttcaatagattctgggttagccaactgtgcagttagagttgaatgtgcaaggctgtttgaatctcgggtccatagaaaatagcctggcatcagggtccattgcaattacattgatgattgagtccctgggctcatgcttggatacccagttcaatggggccagtatcttatgatcgaggactggcttaaagtgcagatgttgaaatgagcctagaaactgagcctccagaggcaatgtccaaactcaagcccacgggcatgagtttgttcccaaatctacaattacagtcctggaaaagattctacgggggtagtagacccggtgactgggcctgaggttaacatcctggagcctgggtctgcagggtctggccggatactggaatttcctgggatgggcttgttttcagacccgtgaaaagtaatgtttacatcactcttcttcatgcatttggaacacatctccttgctgcgctgcttaggattggtaggagggtttcacggttaatgtgaaaagtctaacattcctcaatgcatattcactaggtccacattttcaaccggggttggggggtgcaacctatcatctggattccttaacaactcggaaggcatttttttttgtgcacagagaattgttcccatggattcttctgcaaagggacccattttggagcctccagctctgtcatcgtgtttatatgacttcttgaaattggtaacatattaagtagctgaacctggactgggatgtccgtggactatattgacaggttaaacagttgaaactgatgccagaaacccagtgtaaacactggagccaagcaaagaccgccctcggtgccatattcagagggcttgaagaccatcttcatgtgaagactccctctcctccagaaccacaacgtgaccatccttccaggtagctgctttctaccggtcttgttatttcctgtgtcttgggtttttttttttcaatataactatttctgcatgaacaaaagctcactggtataatgcactaatttcctgagtttttagaaaatctacaaggagttgtttttctttctatacaaatatattaatgtaaaatattttaaaaccaagaataagtttttgattcttttcaaagatgtcctttctgtgaaggttgtgggtgatattattgtccttattcataataattttgcattaatctggaaatttaataagtgtttttaattatttgtattaactctttacaaaattattagaaataaatcttcaaaattaacaataaatacactaatacacactgatagtaatctagaggtctcaatttggatcttgggaagcatgataaatattttaattttctatatacaaaatatcccacagccaaatcttccttctcctggtgattatgtgctgtgatttgcaacttagacatttatcaaaaaggtgaagtctacatgaagttaaattgtctattaaatacatggtaaacatgatctcaacctagtagttatatgtatatttttttctttcaaaggatgattttattcaaccgagtgggttattttgtttccttgtttgctaccgtctcctgtggtaagtattagtttaaggagttcaaattaatagtgtgtgagagaggaatggtcttgcaatctataccactcctggaggaagcctttaactgtacagctttgggggacaaggcagctgttgatactccaaggcaagaacttagatacattaccccaaacacagatgaacagggggaggaacttagagacatcactgcacctgttagcagaaatatctgttttgagtttactctttaacagagcctctcccacccccgcagagttgtttgtctttataatatcagccttctaaataaaaactctacctgaaaattggaaataatatcagatattgcataatgatttgagtctaatccaggtatctgattagtatatagtatttttaatataagacatacagagccatttctaaactgaaagtacctgctttgggtttcacaagtatagtatccctttggcagtctggagggacagctttcaacactcgatgtcagtgctctttccctgtttattcctttgcttttcaggatatgagcatggatggccctgaacagcccctctcaacagtcattatagagggagatttccctgggtataacatgtcaggtgtattctgagtcaaagctgacttagatatagccacacgcaaggattgttttcttcttctttttttttttttttttttttttttggttttttggttttttggtttttcaagacagggtttctctgtgtagccctggctgtcctggaactcactctgtagaccaggctggcctcgaactcagaaatccacctgcctctacctcctgagtgctgggattaaaggcgtgtgccaccacgcctggcaaggattgttttcttgactttcaagtatatggcaaagataggcttgtccttgtaagtagaagtcatttctctaggtaagctcttttttcccatccctctctgctccctacatctggcccatcatctgtaactgctctcctgtaccataactactgccatgttcaaaccaactaaacacgaatagtgataaccagagatgctatgggccatggctataaaattcataatcatgacaggaaaatgagacatgggaatacatataatacttgaaaacaaatactttatataatcctaaagtacaaaataatgatcgccaattttttctttagtctttcatatttttccgcatgaatctatctgttgtataaagtgttattcatgaataataattttaattaaaaattatgaacactaatgaaaaataattttaacttacctttggtatttatagctaatgttaatgcaaatgaacatttatgttatttgttcttcttcatggatattttgtaagtatggacattctctgcacatatccaattatttctatagattaaatttttggaaataaagattttagatagaggagtatgaatacctttgaaggctttatagcatgcattatggtattagcttctagacaggcattctctgtttggttttccccacaagcatgtggaagtgaattaacaatacaatctcttagaaatgagatgtcaatattaaatacgttttatgttaaaaaataaaatttacaggttcacaacactggtttaaacagctaggttaacaaagattaaatttgaaacaatcaatatttgtgcgctggctttgatcacaaatgaaagaaaatcaagcagtacagctttaatataaatgagtttaagagttcagaaatccatgtgcccagtgaatggcttctggagtacttagacactgcccaatgatggcacccgcacatagtgtgtctgcattgctttactgcattgtacgctgctgccttcatctcaggatgcacaatagcaaggcaggaccagcagcccaagtcgccttggaaacaaaagtaaatcggagccttttcctaagtctgagaacaagcctgttacagactagctctggtcaggtcattgtaccagctctgtgtgcagttctggctctggtctgattggctggagcatcaacagcagaagcatcacctccagcaacatatggaccaccacttgtagatggttcctcaggaggaaatctggatgccaattcagcaaggtggctctatgccaggctacaaagtaacagatgcctattggagctcactgttctaagtgggcaggcatggtgcaggaggagctgagagttctacatcttcatcaaaaggctgctagcagaatactgagttccaggcagataggatgagggtcttataggccacacccacagtgacacacctactcctacaagcacacctactcccacagggccacaccttctaatagtgtcactccctgagatgaacacatacaaaccatcacagtgcccatttgctgcaaagagaggcttcgttgatgtgggacagtcactacagttatctagggaaggtggtcatctcactgttagcagctttcatatacttacagttatttacactcctttggtaaattatcttttcatatctgacattgaatgtttaaaacattttagcatttatctatttttgtatctatgtctgcacacgcatgtgcacatatacacatgtgctgtggagcacgtgtggagatgaaggggcatcttgtggaggtcaagaggtcaatttgaaaactgaagggcctcattacaggttgtttaggttaaataaactctgtacaaataatgctgttgttataatcattaccaccaccttcgttatcattgctgccgttatcattgcaactgaggaggataagcagtcccacagttagaatgtgtctagtcactctttttcattgcctgagtcacatgttagtttaccaacattcaattgcaggatagaaacttccaggctatcagcggatcacagtttgtgtttgtgtttgtgtacgtctctgtgcaatgggatggcaagggagcctctgcttgataattatgagatgctaaccacataaaaaaacaagtctctttatagctatcctcaccactgggcctactattcagtgcattgtgcaaatgggacaccttagggtatacacttgggaacatatattcctaggagaatttacccaggaatatctgttctttccaaatataaacctgacttaagaggtaggcatggtgacacctctctgataagaagaaaaacaatattgctaggttggttcatccaaacttgtctcagtggcaggatccccatatagatagaacatagaaactcttacctctttagtgcttattaaaagacatgttgtctagacaaccattccttgaaaagtaaggacaatgtgggcaatgttgccactggagtattccataattaatgaaaacctgactggtgaaaacagacaggctgcctaaggtggaaagctaagtacaaagatttgaacggaatcttttcagggagatcccagttcttcaatggatttaaagagctgctctctaatgatatgtggggtgcaggatacccacatgatggagtcagcagaagcgatgtatctcagtttattttcaagttagcttactttaattttttttttaatttgaaaggtattagcctttttttctgatttattgaaaatattcttttctcatgccatatatcctgattatatattttccttccctctactcctccaagttcctccccagctcccatcttctccccatccactccctttctgcctctcattagataagaacaaggtttctaagagacaacacctatacagaacaacataaaatataataagatgaagcaaaaaccaccacagcaaagttggacaaggcaagtcaacagaaggagaagagcccccaagagaagggacaagagtcagagacccattcaggagtgccatgaaaattctcaggggaaggctacaaaatatacgtagaggaccctgtgcagatctgtgtaggccctggtgcttcagtctctgtttgctcacaggagccttacttagttggttcagaggaccttgttttcttggtgtcctctggcccctctagctctgagactccttctgtctcctctttcacagggatggatctctcagctctgagaggaaggatttgatgaagacataccactcagagctgtgtgtcctaaggactctgactctcccctctccgttctcctctctctactcttctccctctctctcccctcttctctttcttctctcctctctcatctctcctccctcccctccccactctgtaaaatgtctgagtgtgggtttctgcaaatacattttctttatcaagaaatgagcaacagaaaaacagtacccaatacttattattttgcttaaataaggctggctaaacatcaacatgcaacattgcatgttagaaaaaggggacagacaggattgagagtcagaaagagtaagtttatgtcccaggatatctattcactgtgtgatattagccacatttgaactctgagactcagttattgacttctttcatgaaaaaagggggaaaagagaggtgcaactaatggtcctgacctcaagttgccctccaagtgttgtcctaaaaagcattttgaaaaaaatgctgtattttcatttctaaggtgagatgttttcacagcatgttagacagcaggcagaaaaaaattatactgtattttagtagataatttatgtaaaaattattatataggtaataaaagagtcaacttctatgcataaatgttcataagatgactttaaatagcatgctgtattgtttgacagttgtcagacccgtgaagttgtaatgactattaggataaataaaacaggaatgtcaaaacagatgcatttctattaaaatggttacactttcccccaaaatcaacttttaaatcacagggtgtatgactcaactgtataaaaataccttcttcagaggtggggatctagctgccatctacaccccagatgcccagtactgtcagaagatgtgcacttttcaccccaggtgcctgctgttcagctttctcgccgtgactccacccaaagagacaaataaacggtaagatgtgatggtttgtcattgccaggttagatgttacttaaactgcttccagttatatgccaaaatagtgccatgtttctcagagtgttcaaagactctttgcatcagaagctcctaggctgggtcttttcaatgcagacccaaagtactgaacccagagacagactctaaacagccacaacacttgttcacagtgataggaggtagtgatgctacagccaaggcctgaagacagagcatgtgacaagaaagggtccttcctcacactgcaatacttagccttttttcactttcaacatgttattctgtccccacatgtacatctgttatgtatataaatgttattagctgggttatgcatatgagggagaacctgagggttttttttctttctgagattatatggcttcccttaatattaaaaatactaagtccatccattttcctacaatttttgtgatttcatttctcttcagcgcataatagcattgcattacatattttctgttttattcatttgtgtattaattaatttattataaatgctgcaaataaaacaatcacagaaccaaattaaccagactcagagactgtgcaactcagtgaacttctatccagttacagtaattgtttgaaaaggaagccagggaatgtcacaatgcacttgatactttcactatcaaatttatattttaatcatatatattgctttctaataaatggtgacaatttcacctgcatagagaaatatatttaattgctttactagctaccatatttatagggagcaaagttgagaaagtataagccaggaattttgttgataataaatttgagacccagtaggcaagtctcaatagtgcctgcagtggaccagtttacacttttagaatatgcattttctctctctctctctctctccctctctctctctccctctctctctctccctctctctctctctctctctctctctctctctctgtgtgtgtgtgtgtgtgtgtgtgtgtgtgtatgtgtgtgtgttttattaggtggtaattttggcaagaacaattattaaaaatatatttggaaattttaccttaattttctttcatttgatcaagagccaaatgtaaatttttgcttctttttccatacacataactttcatcttcaactatgtgaatttaagaattagaattttaaaactcattctctgatccctacatgctaatctgtaccaaaaaaaacccaaacaaacaaacaaacaaacaaaaaaacccagaccatatgtgagatttacatttttaaaaaaattgaaccaggttctaagattcttataaatagcaacgttaacatagcgttgatattgaagacagaaaaagcctcccattacatggacactaccgggaatcaatacaccagatgaacatcacatgcagacctaactcatagctgagtcagtttttttaaaagtaaattaaaatctttataacaataatcaccattttagaaaatgtggatgtttcagacaggagaatcgtaagtttaaagtcagcttgtgtaagttaacaagatcctttgtcaaagcaaactaagtaaaagcttggggtggcatggggggaggaaaaggctggtgataattattaggatttgattagcatatttgaagcccaggctctcctcctcagtaccacataaactaagaacaaaaccaatgatcttttggaaagaggagccagcgacgttcagaatgagaaaagaatcatcaacccttcagtgtggttggctctccgcacttgcagcgtaaacagtaagaaaaacaacgctatagagagcatggacttgtcgcaagaacgttctcttcagcaagtgacaaggccatgttattagtttcctgaccctgggctttatttattaacatgtacaaaatactgcatcatttcttaatgtgtgtttgttcaattccgcttttaaaatgtgtttttttaaaaaacaggtttggttgcttcatgaaagagagcattacagggactttgccaagaatacaccggacaggggccatttctggtcattctttaaagcagtgtggccatcaaataagtggtaagatgtggattttttttcccaactaaatttgagttaataacactcaaactcagagtagcttttgctgcaagtttatactatgatggacttttagacgagaccaccaagaaagataatagagctgaggcagcatcatggctgtaagaagggggtactttcaccttgataatgttcacatctttatcagttatagtgctcagccttaacgggcctctattacctatggtattcacacacaatgtaagatttgtgggaaatgaatatgcacccagataataggccttccctgtttccgcaacagactttttaggtaagactcggggacatctcatcccaaagtggattttggggtaattggtggtcacccccagaactgactttgccctctccatgtcaaagaacagctgaaaatgtctggagacagtttagattgttaaaattggggaaaatggtactttacggtaatgctcagagttggtgcagtcagactcagcagaaaacattctggccaccacggggccattgataagggattaagactgtggttctcagccttcctaatgctgcagctctttaatacagattctcttgtggtggaggttaccagctatacacttttcatcgccacctcataactgtaattttgctactctaataaatcatagttgtaaacatttgtgttttccaatggtcttaggcgacccctgtgaaagggtcttgcaacccctccaaaatgggttgtgacccacgggttgagcaatgccggtttaagaaatcttatttttgccactcggtccagactgaaagactgagttctgtccatcttgctaagcgtaatatttcttacaaggaatgtgaacgctaggatgttagagcgctttctctgtgactgctgttgcaactgatgtcttagaacacaccatcttaattctcagaccatcttaaaggcttaggataaagaaggcatttttataagatgacagggactgttagaaagtgaaagtgctaaaaaagaatgaggcggtgagttcgattatattgctttgtttttacgtccttcattccgtaggttcaaatttcaaatgttctcattttgctccagtaataataacagccctctcaccacataaacattcagtgtctgcagtttaaattttaggcaatgaatgaagaatgacaatggcttagctataaatccatatatttatatgtacatatatttaacctgaagtgaactacatcaagatcaatccataaactaacttgctgtatattgcttgatgaagtgtctaattactgtgaccaacgacaacattttaaaaaatagaactattgtgacttccccaaagctgcttagttgtctttttctccccctaactttgtaacttttttccaaatactttcaagaaagatcttcaagttaaaaagggatctcaaggagccagttttagtaaaaactattgagaggtgggcttaaagtgtacagataatcattaagaaaatattttatttgtttctaccttatcccaaccctcagctcatttcttttcttatctgaagcaaatttaaaagaaccttatttttacaatttacagtttcctaccctgtaaactgctgggagtttaggacccctacaccctaacataatgctttcctttttttttattggatagtttctttatttacatttcaaatgttataacctttcctggttccctcccccaccccaagtcccctatcccatccccctctctctgcttctattaggctactcccccacccacccacccactcccgcctccccacccaggcattctcctacactggggcatcaagccttcacaggaccaaaggcctttcctcccattgatgcctgacaaggccatcctctgctatatattcggctagagccatgggtccctccatgtgtactctttggttggtgatttagtccctgggagctctggggggtctggttggttgatattgttgttcttcctatggggttgcaaaccccttcagctcctttctattagtttgtatatgcatagtgtctcctgtgtttaattaatttcacaatttttagaaacttatagttatgtacaatagaatattgtttgtgctaacacacacacacacacacacacacacacacacactgcttgcttaactaagtatctaattaaaacaaaacgtaagagcttaatttggcttaatttctgttaaaagaatcaactattttcaatatataagataaattccagtaaaaggatgcttaaatagaattgaagaaacctttaaaaactggtgtgctagcacatggctatcatctcagtaccagggaagcagaggcaaagaacattttaagttcaaagccagtctggtctgaaattcgagattgccacattcagcatggcttgggggctggaaaactgagtaagaacattaagggaagaaaggacagacacacagacccatgtgcagggaagctggaatagtgtgagttatgagactgaacccctaacccccagaatgcttgttacatacacaggggaagggttaaatagtctcagagggcggtcaggcaatctctcctcttggtctataatcatcttggagtagaaggtgaagttgctggtcattgtgcacactggtcaattgctcctaaacactactgctgagacccagggatatctctgcccttttcccatgggtctgagccactgatccttcacatgtggtcctcagactacagaccacagacttcacctgctcctttcacatttactggggtttcccatggttaccacaggagttccaaaccagccaggctagaaaggacaaggaaggatgcagtggctgcggtggtggccagtggtggtggtggtggtggtcatagaacttaagagaggtttaaagcaagaagggaaatgatttcactgtgcgtataaataaattgagacagtctgttaaaagatttgacacaggcatcagtgttgtgactaatagtcacaaatagcaatcagacctgaataggcgaaggaagagaaactgatgcagatcatgattttgttttgttttgtttttttggttgtttgcattgttggtggtggttgttggtttgggtttttttttttgcgtatttgttttttgttttgtttttgacccagaagtcaaaggttcgccgtttgtcaaatactttgtgtctctggcacacactatcaggacccctgttgctgttgccttccttgcttatcagtgcctctgctagcttccatgtggaagtgcattgttttgtattgttgcatactcgttgcagtttaagaggcaaaataacctgtttttaatgctggggccaggtaaacacacccgaggtgagctaatgtccagcagtgtttgataatttagacatgcaaaaaacattttaattcctgtacttaccagggaagtcaccaaaatgggataccaaccttcaaaaatgactctgagggaagagcagtttatttgtgtctaaaaagaagtttggtcgaacgtctctgtgtttcctttcagcttgccaccgagacatatacaaaggacttgatatgagagggtccaactttaatatctctaagaccgacaatattgaagaatgccagaaactgtgcacaaataattttcactgccaatttttcacatatgctacaagtgcattttacagaccagagtaccggtgagtgaggcacagatccgagaggacactccagggatgtgttagcatgaaaaaaaaaatcttccctccagtcaaggtgcaaggggcatgcaatccccagccctgcccctattttattccttatttacatagttaatttcaatgtaatttcctcctaaaggtagcaaactccctgtagtcaactgataggctgtgtatgggcatagtgtcagacaatggtgtctgccactccattcgcagaagggaaaagcatctgttgattgatgttgcccaactgtgcccctctgtggttatcaattcgataacgaatattatccgcacgtctttgtgcgccccaacaaaggaagcataacaacatcttttgtgacatccaggaagaagtgcctgctgaagcacagtgcaagcggaacacccaccagcataaagtcagcggacaacctggtgtctggattctcactgaagtcctgtgcgctttcggagataggtaactagatgacgattattccactgtgattgcgatgccctaaacaagagtgccaagaaatacccacgtgccattcccagggacctggggaatatgatgcctttttatagatgtgattgcatggaaatacttggcaatcggaatgatgttgggttaccagaatatgcccctgcccaggctcaagggttcttatatgataaagagagaaacagaggggtcagtgtcagagtagaaagacttgaatggtctatattgctgcctttaaagatggaagaagagtccaaaagcaaagggtagcagaaattaaaaagggcacagaacaggtctccctgttaattatataaatatattatatttatcttccaaaggactataaaggcagaaaccacaacatgataattttgggaagccaaattcactcatatcctatttgggtgtgggcaaggcttgattttgcaatatacatccagcaggtgcctcagtcgtccaagcaagcaagcgtttcacacaaaatcggaacttagcaactagcctgttaaatctttgccccgttaccttgcaagaatagctgaggccgtggcatattttgtaacactcaggcaattttattttttgcccagctgtaccaggaagtggtccatcaatggacagggtacattcaatgtaagaacaacttcttcatggcttatatgagcttaaaggaacattttgtttttacaagccgagcagagtaaacgtatcctctaattatattgttcccaatcatcggaccttatgctgtgctgtagcgtggtagaaaatcacaggtcaatgtgcatgtgtggaagatacagagaacaaacagaggccttggtttagagcaacctgcccttgtggggtaactgacctagtccagtgagagcaggaacaggtattacccaattcacgtggaatgcaacttcacgactttgcactaggccatactgccaccttgggaagcaagcgtcaccaggatttttgctgcgggcaaagcacactccagccagaacagcacactgctgcaagggtgttttaaacacaggtttaaagacaaggtttttttttgttttgtttttgtttttttttttgtttttgttttttttctgcctcaagtgctgtccacagtctcaacaagtgaggtctgctagcattctgtctaaactccacccccacagttacctggcaacagccaggtaggctccttcctctcttaccctcttgggctctcccctactctccccccctccctactcccttccctcctctctccacatgctcatggctagactctacttctctactctcttcttctctctgcctttctctgcctctactactctcttaactctcccccccccccatgccctgaataaactctattctattctataccttctataccttcgtgtagctggtccccagggggaaaggctgccttggcatggacctgcagagatatccccttcccccacacttcaccatacccccatagaacatatcttaatatctctatatcttttttataatcacaacattggttaaaggcttgttttcagagtttaggcatggactttgaaagctttggagataatcatagttgccctgttaatggatcaatactatttacaattctaattaaaaggactcctcttttcctgttgtaggtttggcatttgccctgatctgtattttcatcttaggaggcagatgtcatgtcccataatcaccaggatccattgcttctccccaccttcccctctctctttttcccctcctatccctcctcctttgtaccccgtctccttctccctctccttcccctccctctctccccctcctcctctcttcctccccctttcccccttcccctctctcttcctccccctttccctctctccgtcccctcctcctccccctccgtctctcttttgtctttctccctcctttcttccttcttcctctttctgtagacacatgctctcaaggaaagggctggaaacactaggcaaaacaggagtcaggtctgataaacttaagccctgtgagcagaattttccagggagcttcttgacaaaccgagtgatgattgttgtctgggaacgagggacagtggctttggaggtgctccaaccattctgacatgttgattttcagcacatccatggggctgttttccaggtctctatggatctgagaaaggggcacaaatataaggcagttcaaccccacacagctcttgctgaaggtcagccatttgtttctatctcaggattagtctcaattgtgtgtccctttggttaatttctagggattaaaaaaaaagtgacttgactcattttactagtatttaacatagttataaaagaagacgaatgcaggctggtggtaacatttgcctttaatcccagtgttcaggaggtaaaggctgagttcaaggctagcccggtctacagagtgagttccagaacaaccagggctacacagagaaagcctatattgaaaacaaacaaacaaacaaacaaacaagatggattctgggcacttgtattctctcagcctcgctaacattctgtaacacttttaattaacagagtgacccacttagggttattgttgttgtgatgaaacaccataaccaaagcaactcagggaggaaaggtttagttcagtttatacttctggataacagtgaagaaagtccaggagggtgggacctcaaacagggcaagaacacggaggcaggagctgatgcagagggggtggaagaatgctgcttactgccttgctcatcatggcttgctcagcctgctttcttatagaacccaggaccaccagcctatggatggcactacctaccatggactgggcccaactctgatcactaattaagaaaatgccctataggcttgccttcagctggatcctatggaggcattgatgctccctcttctctgatgactctagcttctgtcaagttgacataaaaccagccaggtcatatagctaacaacctaacgttggagtggaaaatgtctttggaaagccagatgctcatcttgcctgggtcaggttctgcattttgtgtggaacaataggaagctggagtatagccaactagggcaaccatcttgacggaattcttagaagtaatggaaaatttagaaaccagtaaaggaagatgttaagtatattcaacttgaacagaagactgccttggcgtttggcgaagtctcctctgttctgaaaggctgtcattagggactgggtcagtacacaatcccgtagggttgttttagaaaggtaggactttgtagaaagtaattttttgaagtccctaacatcttcagcggtccagaaaagaagttgactttgtcacatggtggtgaactccttttcaactacaaatgtcccaggaaagttgtaaagtgacatgccagggatgtcttggagatacagttgtaggttggcatggttacctgaacattctcttccagtagcaaggctcttcatgatttttttttttaattcaagtggtagaatcagcttccaagactacacaagtgggatgtgagctctcttgatccaactgtcttgagtttgactggcctatcgttattcttaagtgtccattttattagtatggaatcaaattgattcttacatgctatcgaattgagcaactcatgtaaatagcataaataaaaatagatgaaaaataaaatgatataaggggggatgaaaatgaagcttttctgttctcatcgaagggcatgcttgttagccctttggaatttatgttaatgtcttttcattaaaatgcttctcacaatactcagaaacaaagcatgaaacagcatgttcccaaggcttagtcataatacaagggaaactcgagtcatctaatgtcctattagaaatgacagtgctgcttattctacagcacccagttgctgtctttcccagtagaacaacttttacttttttagcaaagaacaaactacaaattctgagataagttaacaggctttcctcctcttattgaaatggattctctctctctctctctctctctctctctctctctctctctctctctctctctcacacacacacacacacacacacacacacacacacacaatatatcctgatcccggtttccactcccattactcctcccacaacacctcccctccatttctatcattagaaaagaaacaggcttctaagtaataaaacaaggcaaaaatgaaacaagaaaacaaaaccgaacacattgaacttgaacaaattgaagaaacaaacgagagaaggcacaagattcagagagctacacacacgtccgcacactcaggaatccccattaaaaatagtcaagtggaagctatacccaggggacctcttgcagaccagtgcagccccagtgcatgctgcctcagtctctcaacgggcagtttttaacacagggtgctgattcccgccaatatcaattgtcataatcaccttagttactatgttgaaacaaacacaagcaaactcgggcattgtgtcactgaggaatgttcaccgctgagttcacaggttgccccatggatattttccagcactctgcctttgcagacctgaatgtaagccaggtcatcacccccgatgcctttgtgtgtcgcaccatctgcaccttccatcccaactgccttttcttcacgttctacacgaatgaatgggagacagaatcacagaggtgagtgtgagcggcgtgcgcccccttctagccctttccgttccttgcgagggtcttgctcgttgccctaacagcgctggagcctgtggtttaaccggatgcttttcagccaggtgcaggttacttcacagattaacaaattcttcccttccataaaacaagcctactatttagtcaaaccacagcggcagaggcagaagggagcaggaagcattctcactggcattaaggtttgggattggcttgggttacagctgctcatgcaaactgtcctttaatcttgtgagaaaccagagccctgcttatccagatctagggtctagtctgacctcttcatctttacacagcatttcctttatgtacgccgtggggcctgcagaaggatgtgtgtggacataataccatgggtagcataaatccaaaccaacagtcttttgatgccttctctttttcctttttctaattagaaggtggactttaatcctctgtcctcttttctggatgtctgtacctaccaggtattttttgccagagggagaggtgactctacttacatttaagccctgtgatatttttggagtcttgcagtctgactgactgaaaataatttctcagaagaataccatttatggagttgcttagagaggaaggaaggaaggaaggaaggaaggaaggaaggaaggaaggaaggaaggaaggaaggaaggaaagaaggaaggagagagagagagagagagagagagaaagagaaagagaaagaaagaaagaaagaaagaaagaaagaaagaaagaaagaaagaaagaaagaaaggaaggaaggaaggtaggtctgtctagtgcttctaatgctgtcttcttcttctttctcatttatttttaatagaaatgtttgttttcttaagacgtctaaaagtggaagaccaagtccccctattcctcaagaaaacgctatatctggatatagtctcctcacctgcagaaaaactcgccctggtaatgactcaatcttagtggcacatggcatgtgtccgggtttggttcttggttgcttgataaatactatgaccaaaagcaagttgggagagaaaggagtttgttttgttcacatgtcccagtcatagctgattcctgagggaagtcaggctagaaactcaagcagaagcagaggcagggactgggcagagaccatggagaaatgttgcttcttagcttgcttctgtgaatatatatatatatatatatatattcatgctacctgcccagaattgacactgacctggttagacggaccctcttccatccatcattaatccaaagaacatcccacagacatgcctataagttagtctgaggaagacgattctcagactgatggtccatcttttcaggtgactctattttgtatcaagttgacaaacactaacagccacatggtgcagcacatcttggggtcctctaagagttaatgaaatggttctcacgactctagaaactttgccaatgtgactcgtttcctgacttgtgatatatcctttgatatttgtgtatggtgcagaaccctgccattccaaaatttactctggagttgactttgaaggggaagaactgaatgtgaccttcgtgcaaggagcagatgtctgccaagagacttgtacaaagacaatccgctgccagttttttatttactccttactcccccaagactgcaaggaggaggggtaaggaaacctttctttgatgatcagcaaggtaattgttttctagttttctccctgtgtgggggtttaattttagactgttcatttatttccaggtgtaaatgttccttaaggttatccacagatggctccccaactaggatcacctatggcatgcaggggagctccggttattctctgagattgtgtaaacttgtggacagccctggtgagtgaggttcgtttgttacggaactgcatggctggcttggctgttgtgattaatgtcttggtcttatgtgatgggattgtttatatggtttctgttatggtttgtatatgggagtggcactatcagaaggtgtgaccctgttggagtaggtgtgtcactgtgggtgtgggctttaagaccctcatcctagctgtctggaagtcagtattctgctagcagccttcagattaaggtgtagaattctcagctcctcctgaaccaagtctgcctgcatgctgccatgttcccaccttgatgatagtggactgaacctctgaaacctgtaagccagccccaattaaaacttgtccttggtcatggtgtctgttcacagccgtgaaaccctaactaagacagtttccttggataaagggaaagaatgcttatctgtgtctaatcctgccacatctcaacacttttcagactgtacaacaaaaataaatgcacgtattgtgggaggaacaaacgcttctttaggggagtggccatggcaggtcagcctgcaagtgaagctggtatctcagacccatttgtgtggagggtccatcattggtcgccaatgggtactgacagctgcccattgctttgatgggtaagtttcagggtcatcttattataccaatgtgtgtgtgtgtgtgtgtgtgtgtgtgtgtgtgtgtgtgtgtgtgtgtgtgcatgtagaggttaatctcgggtatctacttgtactgcttgttcatcttatttgttgagatagggtaattcactgaacctagtgctaacctttttgactagacagataggtatctgcctgtctctgtctcctggtacatccttagccctagttctgggttggggatctgaacttgaatcctcaggtttgagaaccaagccctttgcccactctgccatctccttggccctgagatatttgtttttaggacaagaaaagtttcaaagtccttgcctagaaaatattataattttaaattcagcctgtatatcctttacgtggttaatttaaaattcaaaggaaaggtaggtagatttttaagcaacaaaatacctttaattcctgctggggcttattttaatcagtacagctacatgaaggctcggataatgagagcaactgtttttggggttggtagactgaacctgattctcccaaaggttcttcaaaaggcacagaagcactcctgtgctcttacttgaaataaacagaaagtaatttttaagtacgtcttgagtgtttccagccacagcgtttatactgtgaactgtaatcctttaggaacacagtgcaacagaatatgagcgtcttccaagattttagcaacagtaaagggtccctgaagggacactgataaaaatgaatccacaataaaaagtatgacaaacccgaggcattctgagagccctctcctgtgctgtgtctgaggattcctctgcagcctttgttcctgacacacaacatcatgcttactgtgcactgtgcatatcgccaggctgcgtagtaccagcagatggtaccctaaacccaatcaatcagactgaggattctttaatggtgtgaaactggtgtgtgtggtatgtgtgccttaggatttctgctcttacaggaacataacagtataattttaaacaatttaaaaaaaaacattaagatgtctcttgtcacagtgtgtctttggattgtacagtgttaaactctgattttcagtgttgctccagctggttagttgagtttcataaaaactcattgaatgaacttgggcttggatattagagtttccaaaactttctaaaccgtccttaatctaagactatcatttggttctccacatttatgtgaagtggtgcttctcagctttatcagttataaaagtaaaaaattaaggaactcctaaaaacattgaggttgttcttcgtcttttagtatgaaatacttagacatgttttaattatttatgtggaaataaacaagcccattattctattaatatgagcgtttgctaataagtggtaaaaattctccatacatcaaaaattgtcttgcagtaaatttctttataatatattaccagtaaatgtttaatatgtgtacctgcttcatatagtcacacacagagacataaaaataaaatcttttcaggcaaaagggagtcttaaatggaagaaagttttattacaaactaaatcttcaaagtccaatacgactgctgtaagcaatgacaggttgccttgccaggaaaaggtgactaggtcatatggaatgttgtctttcttttctctccaccccttcaagaaaatgtgctaagaaaaaggagcggaggaaggatgccaacgttactttgtttccctcctagaattccctatccagatgtgtggcgtatatatggcggaattcttagtctgtccgagattacgaaagaaacgccttcctcgagaataaaggagcttattattcatcaggaatacaaagtctcagaaggcaattatgatattgccttaataaagcttcagacgcccctgaattatactggtatgcagcatatttaagaggaacctgcacaactcaatggtattggtgtcaatttccacttcagtttgcatgagaagagagatctgcagcaattgtctttgtgtcctggttggtgaggctgagggagagatgaggccacctgggcagtagaaatcccgtgtcttcccatacattcactgctatctgaggggcaaaaaagcttcattactttctcagagtggcatgcaactgagtgtatggtattggtctaggaaagattttgacatctggggacattgggcatcttctgacaagattggcagaatgactatggcttaggaatatacaaccatatgaaagtgaacgggactagatgttagtgcccaagaataccctggttgacaatggggggacacggagcatggagctgctttggaggcacatcactccacaggaatggaatgtctgccaacaccattacctgcaagtgtctgtgaacagtcatgagaccttagacagcttggctttcctccttccacctctaatatctgctgcacgcgtgctgatctccgtgttgcttccttgcaatcattaagcaacgtattcaaataaagccctgggagagtatggctatttttgctctgtttctgaattctgctacagtgtatattaaacaagacataagaaagtagacatatgtttgccaataaattttggttgaagagtccctcttccccatagaaatttcgttccaaaatgccatacagaatgtgagaattgtcttgaattgtgggctttagaaattgctcagaaagctggagggtcgttctttttagttttagtaatgggtttcattatatttcatacatatgcatagtatgatgtaattgtattcacatccttcactctctcttgtcattttcactcctgcagttctccctgctcctcccaagtagtcccagactggtcattcttgctttgttgctttgtagaaaaagaataagagaaaaagatagatactaatttttgaagttcccatctatggtttcaattagtccaaatctattcatgaaattttctttcagaattccaaaaaccaatatgcctgccttccaaagctgacacaaatacaatttataccaactgttgggtgactggatggggctacacgaaggaacaaggtacagtatggcatgtgaaatgttcctgtcttacatgctaaagtacatagagtagatccactcaacaagccttactcatgacctttctgttcattccaaactattggtcctctgattcccaagaatgtgaatttttttacattaaacatcaatgagctaatcctttaagaatattactcataatagagattatttttatgagtctgcattaagaactgtggccctatgatactatcaagtccactgaatcccatgtggtcctcagtacttactgtgtccctgtttgctaagttctcccttggtatcaatagctaaggtgccagcatctctcttgaagaacagttcttaatatttatttaaatgccttcttgtaaaaaatctgacatttcctctaattatgccattaaatccttatgtaaaatacatagattcataaagagagaaaagtagattgcagtacagttaccaacatttgttaatagaattttacatagtgatgatcatatttgattattagtgtactcagttgcaaattgttttaaaatctaccataatgttgaagtagttatgggcataaacaacattttcctttctgtcgtaactacaattcaaagtatctgtgacccttacactacagtgctgccaacaatatcacattcctgcattagttatctgaacttaaaactgaagggcgtctgcagctttatttgaaaggttgagaatatagaggcgagtttttcgctttcccttccgctgagtgtatggatgcctcgattgtgtggctctgaactcaagacccctgtgtgctgagacttgagctatttctctagaaataagaatgctttctttctagactgagtgccagataaccagcattagacatatttgagtgattttttttaaaggagatgattggctgtgtcttctttatatttcctgaaccagtcagtactgtattcaattagttcccattttccactacatttacttggctacctatatgtggacacacacatatatacatgcatatacatacatacatacatacaaacatacatacaaacatctgagaaatatagacatgggtagacattaagttatctgtaaatgtatcatttattgcagaacaaaatactactctgctgtcagatgtttgggatgtattctcataaattgtacattttattataatttgaatttctaaaacaatgaaaggcaagaacatcctttaaaggtacaaatgtgtgagacaacattttttgaggggggcatcggttgatataggaggatgcctgagatcatagaaacaagtctgcagaggcttgggtgctagcgagtctgaaatatgtcactagaaggaaggcagcacggatcactgctccttcatctccttctcccccttctccttctccctctcccggtctctcttctccctccacctcttgcttcccttctccctccctttccctctgccctatttattgaacttcctctccttaaaggcacttcttgattgcttcataggtgaaacgcaaaatattctacaaaaggctactattcctttggtaccaaatgaagaatgccagaaaaaatacagagattatgttataaacaagcagatgatctgtgctggctacaaagaaggcggaacagacgcttgtaaggtaatggggaaaaaatacacaatagttccatgaagacagttcattcaaaaacgaatctccaaagttatatttcattagttttggttctgaagttccagagttaaacgatttgaaggctatttgaaacgatagcctttaacaaattaaacacacatagtgcatattatatgttacttataatagttatgctagaatatgtattgctgtgacaggtatgtcacagtgaggacaggggcatgccaaatttaaggacaatttttacatgccatggtcatgctaaaatacaagaaaagtagatttatttgaacttggagtaaagatgctaagtctgttgggtttatctgagaatgggagagggaataaattggccttgtaaccattcacttattttttttttcatggctaatgggatgcacagaaattgagaggctccgtggtggtgtgtaaagtgtgactgccaaatattaaagacatctgtctatgagcaaggggctccttatttgcatcatcaccattacccctctctacctttgtatttctctaccctctgtgacccagggagattccggtggccccttagtctgtaaacacagtggacggtggcagttggtgggtatcaccagctggggtgaaggctgcgcccgcaaggaccaaccaggagtctacaccaaagtttctgagtacatggactggatattggagaagacacagagcagtgatgtaagagctctggagacatcttcagcctgaggaggctgggtaccaaggaggaagaacccagctggctttaccacctgccctcaaggcaaactagagctccaggattctcggctgtaaaatgttgataatggtgtctacctcacatccgtatcattggattgaaaattcaagtgtagatatagttgctgaagacagcgttttgctcaagtgtgtttcctgccttgagtcacaggagctccaatgggagcattacaaagatcaccaagcttgttaggaaagagaatgatcaaagggttttattaggtaatgaaatgtctagatgtgatgcaattgaaaaaaagaccccagattctagcacagtccttgggaccattctcatgtaactgttgactctggacctcagcagatctcagagttacctgtccacttctgacatttgtttattagagcctgatgctattctttcaagtggagcaaaaaaaaaaaaaaaaaaaaaaaaaaaaaaaaaaaaaaaaaaaaaaaaaactgagaaagaggtagaaatctttgtaacatttcatttagaataaaaagagtctctacttgaacctgatgggacatctaaaccacctttctggccattgctgcagagttctgcatggtcatgactgcatgaggtttcctacccctggagcagagccatctgggcatgagggttgcttgtataaacttcatgttcctccctcaggaaataacctctctgcctaggttattgaggaatatcctctctgccaggacagcccttaagactgtgggaaagaactcttaaaacataagttcaagaatatataatttctcagctatgtaaaatataaggatacaatatgaattgtataaggagattcgattcgtggacctaaaagaacaaaggcagctgcactatgagccagcttgtcagaaagatactactgaaggagataaagagataaagagatttagggagtggtgataacagggcaagatcccagccagctaagtttattatttgtgcttacataggcaggcagagtcctgagttcaagatcagcctgggacagagctagtttagacccagggttggtgggaatcccacccagctagcttgttgtctatgctaagaaagacaggcagatctctgaattcatttggcatgttttttttttttaaaaaaagtacctgatgtcttttcttaagaatcaagaggctagagtcatggaatgctgactcatgggttaaacaaaagggaatctagagtaagtgactgagttgatatgtaaataaaagactgggctttagtctgcaagagctgagctacctggatgagctgtctggagatctctgtagagcagaatactagtctctaatttttttagattttttttttttctagtagctactcagagagaactgcttagagaatgaaatgaacattgctattttagttgtgttgttttgtttttttttttttctagaaaatccaaaaatattttatagaagcttctctgactctagtcagaaaacccatgagctagccagagagcttttggatttttttttcctagcaagagaaagctgtctcaagaagagacagctgtctcaagcaaaagagctgccttgagcagaaagctatctctatcagactgcatagccaagagctatctgcagaaagctgtccagctgtctagactacaaggctgtcagcttgcaacccatcatatgactttgagttgtttctttcaccgctcccagacaccccttctcgcaggaacctccctccaagccaaggctggtcctgggcaccttgccacatggtcttggctacagatgtgtgcaagacctgtaaggctatatttttcttcttgtgtgcagctcctgcaataggcctatcacacagtactcacacagggcaagggatctgatgagaacctcctggggaaccctcggggttcagctgatgctgtattctgcaatagtaattcatgtaatgtcattgggtgtaaagtgttgtataaaattcaagcttccaattgagttgaaagtgaaaagcaatcttggaatggatgacattaatcctcatgcaagacaaatttccagcttcccattgattcataaagtgggtcatctgtgcttaactccatttagttaacctggttaatatttagacagaattagccatttacgaactactgtgcaagttaaacagacaaatagaaaagtgaaatttcctaaagaagattaaacttttccttgcatatataaaggcttgttgagtagtgcagagggttaaatatggaagatcctgtgggttatctacagagttcaccatgggaagtgtaagaggtggaagcaaatggctttggaaaaatcttccaagcacacaacttcaacttttaattttgtacaccatttcatcttaatctgtgtggcagttgttttatatttaaaaagaaagaagtggttctcaatgaaaatcttgtatctcaaggtttcatattaataaccctaacaggtatttacacaaggtgtcacagtacttactgggtaaactttgggctttggtttctcaaggaatggcctcatttgagcaaaacagagttttgaaatgagggatttccctatggcgtaaagtaccatgatcacgttgccagctggagtccagctgggctggaatgctctgcttttcattgtgtgttcctgcacaaagtagcccgtcttccactcgaagccttaagaggctgagaaaatgagagggccggataacatcacttttacaagacaaagtggaggcaggaggccctagatctttggcaggtccatccaagaaagggagtgtcacctctggaatggaacaatgccggcactgttcttcctgggccgcacgtggagagcacacagcacaccactaacacttctagagctcaacgggaagctcaaagggctgtctgatctctatctattttttttcttgtagttcttgcttatggctaccagccctacaaactgtcaacaactctgaaggatgctcttgcatctctgcctctctctttcatcagtacttcatgtgaataggaatgtggcaaataggagagatttgggtttgctgttattatttttgttgctgtg

SEQ ID NO: 14 - DNA, 2513 bp, Rattus norvegicus
tgaagactagcttcatgtgaagactccttctcctccagcagcacaaagcaaccatccttccaggatgattttattcaaacaagtgggttattttgtttccttgttcgctacagtttcctgtgggtgtctgtcacaactgtatgcaaataccttcttcagaggtggggatctggctgccatctacaccccggatgcccagcactgtcagaagatgtgcacgtttcaccccaggtgcctgctcttcagcttccttgccgtgagtccaaccaaggagacagataaaaggtttgggtgcttcatgaaagagagcattacagggactttgccaagaatacaccggacaggggccatttctggtcattctttaaaacagtgtggccatcaattaagtgcttgccaccaagacatatacgaaggactggatatgagagggtccaactttaatatatctaagaccgacagtattgaagaatgccagaaactgtgcacaaataatattcactgccaatttttcacatatgctacaaaagcatttcacagaccagagtacaggaagagttgcctgctgaagcgcagttcaagtggaacgcccaccagtataaagccagtggacaacctggtgtctggattctcactgaagtcctgtgctctctcagagatcggttgccccatggatattttccagcactttgcctttgcagacctgaatgtaagccatgtcgtcacccccgatgccttcgtgtgtcgcaccgtttgcaccttccatcccaactgcctcttcttcacattctacacgaatgagtgggagacggaatcacagaggaatgtttgttttcttaagacatctaaaagtggaagaccaagtccccctattattcaagaaaatgctgtatctggatacagtctcttcacctgcagaaaagctcgccctgaaccctgccatttcaagatttactctggagttgccttcgaaggggaagaactgaacgcgaccttcgtgcagggagcagatgcgtgccaagagacttgtacaaagaccatccgctgtcagttttttacttactcattgcttccccaagactgcaaggcagaggggtgtaaatgttccttaaggttatccacggatggctctccaactaggatcacctatgaggcacaggggagctctggttattctctgagactgtgtaaagttgtggagagctctgactgtacgacaaaaataaatgcacgtattgtgggaggaacaaactcttctttaggagagtggccatggcaggtcagcctgcaagtaaagttggtttctcagaatcatatgtgtggagggtccatcattggacgccaatggatactgacggctgcccattgctttgatgggattccctatccagacgtgtggcgtatatatggcgggattcttaatctgtcagagattacaaacaaaacgcctttctcaagtataaaggagcttattattcatcagaaatacaaaatgtcagaaggcagttacgatattgccttaataaagcttcagacaccgttgaattatactgaattccaaaaaccaatatgcctgccttccaaagctgacacaaatacaatttataccaactgctgggtgactggatggggctacacaaaggaacgaggtgagacccaaaatattctacaaaaggcaactattcccttggtaccaaatgaagaatgccagaaaaaatatagagattatgttataaccaagcagatgatctgtgctggctacaaagaaggtggaatagatgcttgtaagggagattccggtggccccttagtttgcaaacatagtggaaggtggcagttggtgggtatcaccagctggggcgaaggctgtgcccgcaaggagcaaccaggagtctacaccaaagttgctgagtacattgactggatattggagaagatacagagcagcaaggaaagagctctggagacatctccagcatgaggaggctgggtactgatggggaagagcccagctggcaccagctttaccacctgccctcaagtcctactagagctccagagttctcttctgcaaaatgtcgatagtggtgtctacctcgcatccttaccataggattaaaagtccaaatgtagacacagttgctaaagacagcgccatgctcaagcgtgcttcctgccttgagcaacaggaacgccaatgagaactatccaaagattaccaagcctgtttggaaataaaatggtcaaaggatttttattaggtagtgaaattaggtagttgtccttggaaccattctcatgtaactgttgactctggacctcagcagatcacagttaccttctgtccacttctgacatttgtgtactggaacctgatgctgttcttccacttggagcaaagaactgagaaacctggttctatccattgggaaaaagagatctttgtaacatttcctttacaataaaaagatgttctacttggacttgaaaaaaaaaaaaaaaaaaaaaaaaaa

SEQ ID NO: 15 - DNA, 30000 bp, Rattus norvegicus
attcctccagcccctgtatcacgtcaaactcgaaactccagctccaggactagctgcaggcattgatgcttctgcgctgtttccattctgtgatcatgtcttctccatacctacctctaagttttccatgaggtctcaaagtaaaagctttaagaagaaaaaaaaagtgttgtccagcaggtttcagtaagctttgctggagaggaccagataataaaatcttagtttgcttgtttgttttgttgttgttactgaagaccgttctataatcataggaagtaggcaggcatacatcgtgcagcagtgaatggacatggttgtgttccattaaaacttcagctagaaggacaaatcccaagcaagatttgttctgtaaacagtggattattaactcagtactgggtggatctgaacatgaacttccagtgtaataaaaaggtagaaaagcagaagtgtgaagaatcccgagagctcaggggagaccactgcttctgctcacattcctggcccaagaggactccccctggagacctctggacacaagaaccgaggagcagtctggttcctgcctgtacccagaactgacactgtaacacatctacacagtggagtattactcagctattaaaaacaatgacttcatgaaatttataggcaaatggatggaagtagaaaatatcgtgagtgaggtcacccaatcacaaaagacccacacggtatgccctcactgataagtggatattagcccaaaagctcggattacccaagatacaatccacagaccacaggaagctcaagaagaaggaccaccaaagatgcagatgcttcagtccttcttagaagggggacaaaaatattcataggagaagataaggagacaaagtttggagcagagactcaatgaatggtcattcagagctgccccacctggtgatccagcccacatgcatacagccaccaaacccagacagtatttctcatgccaagaaatgcatgctgacaggagcctgatatagttgtctccagagagactttgccagctcatgacaaaaacagaagagaatgtttgcagccaatcattgaactgaaaccagggtccctgttggaggagttagtgaaaagattgatgcaaccccgtaagaacaacaataccaaccaaccagagctcccagggactaaactaacttccaaagagtactcatgaacaggccaatgtctccagctgtatgtatgtagcacaggatggcctttctgggcaccagaggaagaagcccctggtcctgccaaggctggaccctcccccagtgtaggggaatgtcaagatggagaggtgggaagaggtaggtttttgggttgggaaaaggtgataacatttgaaatgtaaattttaaaaatccaatttaaaaaaggtagaaaaccaataccttgctttgattctcctataggagctgtctaccccacccccacattgaggtgtgcctccaggaaatttcaatagaagtatacacacacacacacacacacacacacacacacacacacacacacacacttgtaaaggcaaataggtaagaatcaagctgttagtccccaaataaagagatatgaccattttcaaaatgggagacctatgcctgaattgtgtgtccctagtataaagcacttctctttcttcagcataagcacttaaacgcatttcccatgtataatttatttaaaatgggttcttgatatgcttgtaatataatgatatcttggtatacatgaacactgtaacattatttccactctaaagttacttaacacagtcaccatctcagacaattattatgtatgttacgaatacctgcataccagggtacagtgtgtacacctataatccagcactctgaagatctagattcagtggttctcaacctggggagaggggtcacatatcagatatttacaattcataaaagcagcaaaattacaattatgacgtagcaacaaaatacctttatggttggggatcactatacatgaggaactatattaagtcgcagcttagaaaggttgagaactactgctctataggatgcaaagacagctcaggggtgctcttgaagagaacccaagctcagttcccagcaaccacatcaggtggctcacaaggacctgtgtctccagctccaggggacctgattccctctgtcggtctgcaacgtgcatgcatttgcagtgaaagagacacatcattagaaataaaataaatggttaaaatttaactaatgttgctattgctgggcatgggatcttgcagtctattagttctaaaagctgaaattttgtatcctttcacaaacaccacccatgacaccaagtttcagatcctgacactcaccatcccacttgtttctagggcttgcctttttcaaatgccacatgtaagtatagctcttcaaatggccatatgtttttatatctccaccagttttgcatcactgcaatccaataccttgagcccctatgtcgaatttataatctgcccatcagttgactttaatttatttagggttgcttataagttcctaatttttttcttttggtgattttgtttttcttttctgattatttgtgatcttctggctttgtgttggtgtttgcacttttagataagaggctattttaaatttaatttttaaaaatttatttattcacccattgcaaggctatgtgtgtgtgttctgtgcaggttctggggattggactcaggtcatcaggcttgatggcaaatgcttttgacctactgagatgtcttgtaagctccacgatgattttagacttttaaagcttgcttcactgggcaaacctagtagtcatgtatctcatcaatggattctgggttagccaactgtgtagttagagttggatatgcaaggctaggtttgaatcttgggtccacagaaaagagcattgcatcagggtccaccgtgattacattgatgactgaattcctagagcccatgcttgaatcctcagatcagtggggccacgatcttatgattgaggactgccttaacatgttgatattgaaatgaacctgaaaactgagcctccagtggccatgttaacgaactcaagcccgtgggcatgggtttgttcctgaatctacaatcgctgtcctggaaatgagccctggaaatgggacaatctggtggctggcctgaggtatcatcctggagcctgggtctgcagggtcagcctgataactgggatttcctggaatggacttgtttacatctgtctttattcatagggaacacatcgccattctgtgctgcccaggcttagtagcagggttttatggttaaagtgaaggatcgaacactcttcaatgcctattcactatgtccacagtttcaccgggggctgtaacctatcatctggctttcttaacacttggaaaggcatggggaattgttcccatggattcttctgcaaagggatgcgtggtggagattccaattttgtcatggtgtttacatgactttctggaatcggtaacatattaagtacttgaacctggactggaaggtccatggactgtattgacaggtcaaacagaagacactgatgccagaagcccagtgtcaacactggagccaagcagagaccaacctcagtgccatattcggagagcttgaagactagcttcatgtgaagactccttctcctccagcagcacaaagcaaccatccttccaggtagctactctccaccattctcattgtagcctatgtcttaggaatttatttttttaaaaaagtataactatatctgcatgaaaaagtctattggtgtaatgcactaatttcctgagggtttagaaaatctacaaggaattgtttttctttgtacagctatattaatgtaaaatattttaaagccaaggataagcttttgattcttttcaaagatgctctttatgtgggggttgtgggtgatattattgtactcattcataataattttgcataaatctagaaatttaataagtgtttaattatttgtatcaactctctttacaaaattaatagaaataattcttcaaaattaacaataaatacactaatacacactaattgtagtctagaggtctcaatttgtatcttggggagcatgataaatattttaattttctatatccaaaatgtcccctcctccaaatcctctttctcctggtgattatgtgttgtgatttgcaatttagacatttaccaaaaaggtgaagtgtacattaaattaaattgtctattaaatacatggtaaacatgatctcaacctagtagtagctaaatttatttttttctttcaaaggatgattttattcaaacaagtgggttattttgtttccttgttcgctacagtttcctgtggtaagtattagcctgggagttcaaattaagttagtgtgtgaaactataccactcctggagaaagcctttaaaagctttggggaagaaggcagctgctgatagtccaaggcaagaacctctccttagatacattactcctgacacagaacggggtggggggggaacttagaagcttcaatgcttctgctagcagaaatttctgtatcaagatttctctctagcagagtcctcccaccccaaagatttgcttgtgtttattaccagccctctaaataaaaactctacctgaaaatcggaaagaatatcagatattgcataatgattgagtccaatccaagcttctgattagtatatggtatttttaatataaggcatagagagccatttctgaactgaaaacacctgctttggatttaatgagtgtagtaaccctttggtagtgtggatggacagctttaacactagatgtcagtgttctttctctgtgaattccattacggttcagaatgtgagcatggccctggacacccccttctcaatagtcattatagagtgagatttccctgggcatatcatagtattccgatcaaagctgactttgtctagccacacctcaagggctgatcttgactctcaagtatttggcaaagatgagcttatccttgtcaatagaagccatttctctgggtaaactcattgttttccctctctgctccctccatctggcccatcaactgtaactgcttttctgtgccacaactactgccatgatcaaaccaattaaacacgagcagtggtagtcagagatgctatgggccatggctataaaatttacgatcatgacaggaacgtgagacatggaaatacatttaatacttgagaacaagtactttacatagtcctaaagtacaaaataatgattgcttgcttttctttagtctttcttatttttctgcatgaatctgttgtataaaagtgttattcgtgaataataattttaatgagaaattatgactattaatgacaaatcatttttgacttacctttgctatttatagctaatgttaacacaaacaagcacttttgtcattcgttcttcttcacgctattctgtatgcatgtgacattctatgcacacattcaattatttctactgattcaaattttagaaataaaaatttttagatacaaacatgtgaatacctttgaaggttttatggcatgcattatggtattagcttccagaaaggcatcctctgtttggttttccctacgagcatgtgggagtgttcaaccatcccagttagagtgagccctaacaggcatctgttactttgtagtctggcgtaggatcaccgttctaaaatagcatccagatttcttcctgaggaaccatctccaacggatggcccacatggtactggagatgattctcctgctgcagtcagaccagaactgcagacagtgctggtgtgatgacctgaccagagctagtcttgtaacaggctttttctcagacttagaaaaaggctcagatttatttttatttccaactcaacttgagctgctggtcctgccttactagtgtgcatcttgagatgaaggcagcatcacacaatagagtaaatcaacgctgacacactgtgcatggatgccattcctgagcagtgtctagtgctccataagccattggctgtggacacatgggtttctgaactgttaaactcatttatattcaaactgctctgattgattttcttttatttgtgaacaaagccagcacacaaatattgtttcaagtttaatctttgttaacctggctgtttaacccagtgttctgagtctgagactcttacattttgtttttttaacataaaatgtatttaatattgacatatcatttctaagagattatattgttaattcagaaaaagaatgtgttatctacattcttaaaatatcataaagatttagacaatgatttcttttttagaaagttatctaaattatcactaatatgaaatatcaggtggaatatcgtgtatttgtttttctagtttagaaagaattaatctgtagcttgtatgtattgactttgtgaatgatgatagtttttaaatgtttttaattgacactaggattataccacccctttcctccctctagtttctcctaggaacacttccttgagcttctcccatgttcccctcactctgaagctgattgcctctcttttcatttagtattaatgctacatatgtacatatgtacacagagatgtatgaatgcaacttgttgagtccatttttgtttgtgggtatatggtttgtgtgtgcttgtgcatattgaacaactagtaagtgggctcagctctggaaaaggttaattctctttctccaaaaggtcattagctgcctatagttctttgtctaaggtggggccccatgaaattcccccttccatgttactacatccattgatattgccatcgttctggtcccttctgggagggactgtttcacagcaaacttcctgatattctggctatcattacctttctgtgttctctttcatgatatccctcgagccataggtttgggatatgagatgtagatatatcgactggggctgggagccccacagtatgttgacctccgcattgtgtccagttgtggatttttgtgatggtgtctgtcttagttagggttttactgctgtgaacagacaccatgaccaagataagtcttataaaggacagcatttaattggggctggcttacacattcagaggttcagcccattatcatcaaggcaggaacatggtagtgtccaaggcaggcgttgttcaggcagagctgagagttctgtcttcatctgaaagctactagcagaatgctgagttccaggcagttaggatgagggtcttaaagcccacacccacagtggcacatctactccaacagggccacaccttcgaatcatgctaatccctgagttgagcaaatacaaaccatcagtgtccatttgctaccaagagaggcttctttgatgagagagagtagctacctttatctaggaagggtggctcctgcactgttagcagcttttatacacatatagttacttttattaattcggtaaattatcttttcatatctgatgctgaattttaaaagttttagcatttatttatttttactctatatctgcacatgcgtatacatatatacacatgtgctgtggagcacatgtggagatgagaggacaacatgtggaggctcagttttctctctgccactcacctagagttttgagttaagatgcttcatttatctatggaatttttccttttctttctttttgattatgtacatttttaatatgactaaataactcagtcatggtccatggacctgcagtttattgaaagacatcattatagatcaattaggtcatacagactctgtgcaaacaaggctgtcattgttctaatcattactgctcaccatcgttatcattgctgccatcatcaactgaggaggataatccattctccagttagaatgtttcgactcattcattctcattgactgagtcacgtgttagtttaccaacactcaactgcaggatagaaacttctaggctgccactcgatgatggtttgtgattttgtatgtgtctgtgcaatgggatagtgagggagtctctgctcaataattatgagatgctaacacattaaaaaaaaaagcaagtctctttatagctactgtcagcactgggcctgctactcagtgtgttgtgcaaatgggacagcctgggttgtacacttgggaacatatattcctaggagcaattacccaggaaaatctcctctttccaaatataaatctgacttaagaaggtaggcatggcaacacccctctgataagaagaaaaacagtattgcaaggttgcctcatccaaattggactcagtggcaggatctccatataagtagaacatagaaactcttaactttccggttcttattgaaaaacgtattgtctagatagctattccttaacaaacaatggcaacatggacaacactgccactggagtattgcataattaatgaaaacttgactgctgaaaatggacaggctgcctgttggaaagctaagtaaaatgatttgaactgaatcttttcagggaaatccgaattcttcaatggatttaaagacagttctctaatgatatatggggtgcaggatacccacataatggagttgtgagtcagcacaagcagtgtatcttattttcaagttagcttactttcatttttgtaataatttgaaaattatttagcctttccccattatattgaaaatagagtcttttctcatgcaatatattctgattatgacttcccctcttcttccccttccagttccacccccacctcccatcttctcctggtctaatccctttctgcctctcattagataagaacaaaacttctaagagatagcaatcagacacaacaaaataaaatataataaaacagaaaccatcacatgaaagttgtacaaggcaacccaacagaaggaaaagagcctaagagaaggcacaagaatcggagacccattcaggagtcccataaaaatactcagctgaaagctataaaatatatgtagaggaccctgtgcagacctgtctaggccctggttcttcagtctctgctcatatgagcctgacttagtggaatcacaggactttgttttcttggtgtcctccatcccctctaggtcttagagtctttctccctcctctttcacaggaatccctcagctctgaggggagggatttgatggagacacaccatcagagctatgtgtcctaaggactctgactcttccttctcttcccctccccccatctctctctctctctctctctctctctctctctctctctgtgtgtgtgtgtgtgtgtgtgtgtgtgtgtgtgtaatgtctgaatgtgggtctctacaaatacaattttattaagaaatgagctagtaggaaatcagtactcaatatttattattttatttaagtaaggctgggtaaacagcatcatgggacagcacctgctgtgctggaaaaaaggacagaaaaggattgtgagtcaggaaggatgagtttatgtccgaggatatttattcactgtgtggtactaatgacatctgaactctgagactcagttattgacttccttcatggaaaaaaaaaaggaaaaaacaaaaaaaaagaaatgcaaataatagtcctgacctcaagtcgcccttaaagcgctgaggaatctagggagattgttgtcctaaaagcgttttgaaaaaatgctgtatttccatttttaaggtgagatgtttccccagcctgttagacagcaggcagaaaaaatatattttaacagatactttatgtaaaattatataggcaataaaaattttattgcataaatttattcaattttatgcataaatgtccataggatgactttatttattttttttttttacgccccgcgggggcccataggatgactttaaatagcgtgctgtattgtttaaacagttgtcatatgtttcattctacctgtgtggttgtatatatctttgggtagtcattgggataaataaaaaggaaaaacaacatagatgtatttctactaaaatggttacactttctccggaatcaacttttatatcacagggtgtctgtcacaactgtatgcaaataccttcttcagaggtggggatctggctgccatctacaccccggatgcccagcactgtcagaagatgtgcacgtttcaccccaggtgcctgctcttcagcttccttgccgtgagtccaaccaaggagacagataaaaggtaagatgtccgtgagtccaaccaaggagacagataaaaggtaagatgtccgtgagtccaatcaaggagacagataaaaggtaagatgtgctgttttatcactgccgggtgagacgtttctcaaatagcttcctgtcgtatgcaaaattggtgtcatagttctcagagtgttcacagactgattgcatcagaagctcctaggctgggttttctccaatgcaaactactagagtgctgaacccagagacggagattctaaacgaccacggcatttgttcacacagcataggagggagtgatgcttcagccaaggcctgaagacagagcgtgtaacaagaacgggtccttcctcacgctgtaatacttagctttcttcttcactttcaacacgctatactgtccccacgtgtacacttgttatgtgtataaatatgttattagtcaggttctgcatctgagggagaacatgagttttttcctttctgagattatgtggcttcacttaatatcacacattctaagtccatccattttcatacagtttttgtgatttgatttttcttcagcactaaatagcattcctttatatattttctgttttattcatgatttattatgcattaattataatttactacaaatgctacaaatgaaacaatcacacacccaaattaaccagatccagagactgtacaattcagggaccttctatccagttacagtagtcatttgaaaaggaagcatggaacttcgcaaggattctatactttatcaaatatatatatatatatatatattttaatcatatatatatattgcttgctgatagaaggtgaaaatttcacctgcataaagaaatatatttgttttacttgttaccgtatttatggggagcaaagttgaagatgtacaaaccaggaattttgttgataatagatttgaaatccagcaggcaagcctcaatggtatatgtagtgagcctctctctctctctctctctctctctctctctctctctctctctctctgtgtatgtgcatgcatgtgcatgtatgcatgtgcgtgtatcattaagtggtaattttggcaaggacaaatattagaaatatagttcggaattttaccttaattttctttcatttgatcaatagtcaaatgtaaatttttgccttccattttcatacacattacttttatcttcggtctatctgaatttaagaattagaaatttgaaactcattctctgatctctacatgcttacctgtacaaaacaaaataaaacaacaaaaacaaaaccaaaacccagactgtatgtgtgattcactttttttaaaacttgaactaggtcctaggattcttataaagagtaaagttaacaccgagctgatattgaagattgaaaaaacctccccttatatggaaactaccagatcaataaaccagatgaatatcacatacagacccaacttagctgattcaaattttttaaagtaaattacaatatttataaaaataatcaccattttagaaaacgtagaagtttcagacaggagaatcattggttttaaaatcagcttgtgtaagttaacaagatcttttctcaaaatagactaaataaaagctggcagtggaatgggaagaacgaggctgttgagtgattagcacttgatgaacatatctgaagcccaggctttcctcctcagtcccacataaaccaaaaccaaaaccgattatcttctggaaagaggagctatgaaataatcctcaactctgggatgtgggtggccttctgcactcgaagcatgaacactaagaaaaccaacgattgtagatagtatgaacttgtcttaagaatgtcctttccagcacatgtcgagaaatgtaattagtttcctgaccttattttatttattaacatatccaaaatgctgtataatttcttaatgtgtatttgtcgttttattccccttttaaaatgtgatttttttttaaaccaggtttgggtgcttcatgaaagagagcattacagggactttgccaagaatacaccggacaggggccatttctggtcattctttaaaacagtgtggccatcaattaagtggtaagatgtggattttttttccaactaaatttatgttactagcactcaaactcagagtagtttttgctgaaagtctatactatgatggacttttagaagagaacaccgagaaagataacagacggagcagcatcatggacctaaggaggggtctttcttcctgataatgttcatgtctttatcagttgtaatgcacggccttaaagggcttccattatctatagtactcacacacaatgtaagatttgtgggaaatgaatgtgtagtccagataataggtcttctgttccatagcagacatttcagataagattcaggacacatctcaccccaaagtgaaccctggagagtaagtcattgtcaccaccagaactgattgtgccctttccacatcaaacaacagttggtattctctggggacaatttaggtggttacaactgggagagatggtactctatggtaatggccaaggttggtgcagtcagacacaacaacaacaaaaaaagttctgaaaagttctggcccccactagggtcattgagaagggtttaagatagtggctctcaactgtccttacgctgcagctctttctcttgttgtggtggctcccaaccataaactatttacatcaccatttcataactataattttgctactcttatgaatcataattataaatatttgtgttttccagtggtcttaggcaactcctgtgaaagggtctttcaatccccccaaaaggggtcatgacccacaggttcagaaatgctggcttaagagatcttgtttgtcactcagtccagactgcaggactgagttctgtcaatcttgctaagcatactatttcttgcaaggggtgtaaatgcaaggatgttagagagctttctctcaggccaccattgtaactgatgtcctaggaaacaacatcctaatttccacaccatcttaaaggcttaatacaaagagggcgttttaataaaacgatgggggctgttagaaagtgaaagtgctaacaaagaatgagttgggttgtatcgtttagctttgtttttaacgtcattcattccgtaggctcaaatttcaaatgttctcattttgccccaataacaacaaccctctcaccacatatacagtcagagtctgaaacttaagctttagggagttaatgaagggtgacaatggcttagttataaatactgcttcactggtgtaatatcttctctatcttataagatcaaacccatataccaatataacttgctgcatattatttgatgaaatgttgtgtctaattattgtgaccaacaacaaaatataaaaaaatagaaacattatgccttttccaaagctgcttagttgtcacatgccccctcccccctagcttaaccttcttcactgagtttggctctaaagtttatttgcaactttctcccaaatacctttgagaaagatcttcaagttaaaaaatgtttgcaggaaccaattttagtaaaaactattgagaggcaggcttaatatttacagataatcattaaaaatatgttttatttgtaactacttcatcccaatcctcagttcatttcctttcttatctgaagcaaatttaaaagaaccccatttttatgatttacaattttctgccctgtaaactgctgggagcttagcacccctacaccctaacataatgctttttcaattagtttatatatacagtctgtctcctgtgtttaaattaatttcacaattcttagaaacttatagttatgtacaatagaatattgtttgtgctaacacacacacacacacacacacacacacacactgcttgcttaactaagaatctaattatgttgtcttaaaaacaaaacctaagagcttaatttggcttgatttctgttaaaagaatcaactatttttaacatgtaagataaacttcaatgaagggatattttaaataaactgaagaaacgttttaaaactggcgtgctagtgcatggctataatcccagcactagggaagcaggggcaaagaacattttaagttcaaagccagcctgatctgaagtgggagattaccacatccagcatggcttgggtcctggaaaactgagaggaacatcaagagaataagaaaggacagacacagagacccctgtccagagaagctagaacagtgtgagctttgagcactgaacctccaatccccagagtgcttattagacacagcacagtggaggggttaactagtcacagaggggtgtctccctcttggtctctcctcttggtctgtaatcatcttggagtagaaggtgacgtcacggtacacactggtcaatagttcctaaacactgttgctgagacccagggaaggctttgccgaagtcccatggggctgagccattggtccttcacatggctacggacttcaaactacagatttcacctgctcctttcacagttactcagggcttcccatggttaccacaggagttccaagccagccagttttgaaaggacaagaaagggttcggtggctgcggtggtggtggtagtggtgatggtggttaatagaatttaagaaagttttaaagcaagaaggaaaatgatttcattgtgcatataaataaattgagataatctgttaaagattcgacacagatatcagtgttgtgactaacagtcacaaatcacaatcagacctgaatagatgaaggaagagaaatagatgcagatcgtgattttgttgatttgtctgtttttttgtttcgttgttgttgggttttggtttggggtttttgtttgtttgtttttgactcagaagtcaaaggctcgatatttgtcaattactttgcgtctctgtcacacactatcaggacggttgctttcttggtttatcaatacctctgatagccttcttctgaaactgtattgttctgaattgttgcatatcccttgcagtttaagaagcagaataacctgtgtttaatgcaaaggtcaggttaagcacacctgcggtgagctaatgtctagcagcacttgataatttagacacgtgataaacattttaattcctgtacttaccagggtggtcacaaaaatgggatactagccttcaaaatgactccgagggctgagcagtttatctgtgtccaatatacatatattataatacatatatatacatatatgtatgtatatatatatggtcgaatgtctctctgtgtttcatttcagcttgccaccaagacatatacgaaggactggatatgagagggtccaactttaatatatctaagaccgacagtattgaagaatgccagaaactgtgcacaaataatattcactgccaatttttcacatatgctacaaaagcatttcacagaccagagtacaggtgagtgagtcatggttccctgagaggacattccaggatgcatcagcatccgcagtgaaaaagacaagtctgcttccctccagtcaaagacaaggggtgggcagtcctgagccccttccttccttaaatttcttagttacatacttaatttcagtggaatttcctcccagagatagtgaacttcgtttagtgactggtaagctatgtatgggcataatgtcagacaatgatgtccgccactccatttgcagccgcctgtcccctttgcagaagggaaaagtgtctattgatcactaatggcccaactgtgcccctttgtggtaacaaatattatctgcacacctttgcacacctcaaggaaggaagcataacatcttttgttgacactcaggaagagttgcctgctgaagcgcagttcaagtggaacgcccaccagtataaagccagtggacaacctggtgtctggattctcactgaagtcctgtgctctctcagagatcggtaattagatgacgattattcctctgtgtctgtgatgtcctaaggaagggttcccagaaacatccacatgctgttccccgggacccaggaatatgatgcctttttatagatgtgattacgtggaaatagtttgcaatcagagttatttgggattaccagaatatgtgcctatccactctcaggggttcttagatgataaagcgggtaacagagaggtcagtgtcagaggtagatagacttgaaaggtggaacaagagtccgaaagccaaaggggtaccagtggtctgtagacattgaaaaggacatagaacagaggaacagaagcaagccaacctttgactggcacccaggaagacttgctttggccttccagcctctaggaaaggtgataaatttctgttgctgtaacctctagttttactataatatgcctacaacaacatcattagaagaggaagctccaccataaagaaaaccacaagatcattctgtggtatccgtatccagagaaatatgcacattgtcgtgaatcaaccaagccctgtaacttcacacacagaggtagcgctaaatgaattacccggacagttgccttcaaatttaggacaccaaggtgtcagtggtgagatttactgagaccagtccacttatagtaaatagtaccaatactgaatgctggccctacaccaggccctgtgttaggtttccgaattctgtggtatgacctctgtctgaaagactgagaagtcagaagcaacatagctctttccctatttgtgttttcttttctctatgtgtccccaccaggctgtgccattcagatggcttaaatatattaactatttaattttaatattccccttttctagtttttggaaacttgtctataggagatagggctctttattcaacagtgttcccttttgtatactgcgcttatcttagactgcaccctgcagctatagccagatgccagaggactgggaaacaggcaatttaaaactcaggatgctgactgctgcaaataccaattgtcataatcaccttagtttctatgttgaaaagcaagcaaactccacatcgtgtcactgagaaatgttcaccactgagttcacaggttgccccatggatattttccagcactttgcctttgcagacctgaatgtaagccatgtcgtcacccccgatgccttcgtgtgtcgcaccgtttgcaccttccatcccaactgcctcttcttcacattctacacgaatgagtgggagacggaatcacagaggtgagtgtcagcagcatatgctcccttcttagccttttccggtcctagcagaggcttgcaagggtcttgctggtttccctaacagcgctggagcctgtggtttaacaggatgcttttcagacgggtgcaggttacttcgcagattagcagattcatcctcacactttccttcttccataaaacaaacgcgctattcactcagaccacagtggcaggggcaaagggagcaggcagcgttctcactggcattaaggttgaggattggcttgggtaacagctgctcatgcaatccatcctttaatcttgtgagaaatccgagccctgcttaccctgatctagggtctagtctgacctcttcatctttacacaacacttcctttatgtataccctggggccggcaaaaggatgcgtgtggacgtaataccgcaggcagcataaatccaaaccaacagtcctttgatgccttctctttttctttttctaattagaaggtggactttaatcctctgtcctcttctctggctgtctgtacttactaggttttttttttttttttttttttttttgccggagggagaggtggctccatttacatttaagccctgtgatattttggagtcttgttgtctgactgactgaagagaatttctcagaatacaatttacagagttgctttaaaaagaaaggaagaaagaaagaaggtaagtaggtaggtaggaaggaaggaaggaaagaaggaaggaaggaaggaaagaaggaaggaagggtgggtcttagtcagggtttctattcctgcacaaaacatcatgaccaggaagcaagttgaggaggaaaggaattattcagcttacacatccacatcgctgttcatcaccaaaggaagtcaggactggaactcacacagggcaggaggcaggagctgatgcagaggccatggagggatgttacttactggcttgcttcccctggcttgttcagcttgctctcttatagaacccaagaccaccagcccagggacggcaccacccacaatgggctgggtccttcccccttgatcactggttgagaaaatgccttacagctgggtctcatggaggcatttcctcaagggagtctcctttctctgtgataactccagcttgtgtcaagctgacacacaaaaccaatctgtacaggaaggaaggaaggaaagaaagaatatgtctagtgcttctaatgctgtcttctttctctttcttgtttatttttaataggaatgtttgttttcttaagacatctaaaagtggaagaccaagtccccctattattcaagaaaatgctgtatctggatacagtctcttcacctgcagaaaagctcgccctggtaatgtcactcaacctcgatggcgtgtgacttgtgtcctggtttggttcttggttgctgtaataaataccatgaccaaaagcaagttggggaggagagaggtgttttgttcacatgtccctgttatagccgattcctgagggaagtcaggctaggaactcaagcagaggcaaagacaggaactgagcatagacctcagagaaatgctgcctttttgacttgctcctgtgattgatcatatatgtgtatgtgtatgtatgtgtatgtgtgtgtttgtgtgtgtatgtgtatatgatgtgtagatgacgtatgtatatgtgtatgagtttgtgtgtgtgtttgtgtatatgatgtgtagatgacgtatgtatatgtgtatatgtgtacgtgtttgtgtgtgtatgtgtatatgatgtgtagatgtatgtatatgtgtatgtgtttgtatgtgtgtttgtgtgtgtatgtgtatatgtataggttgtagatgtataagtatacgatgtatatgatgtatgcatcatgtgcatatgatgtgtgtgtgtgtgtgtgtgtgtgtgtatcagtagcccatgaccacctgcccagagtggatactgccccccagttggctgaccctcttctttccatcattaatccaaagaacatcccatagacattcctttaagttagcctgagggaggcaattcttcaagggatgttccatcttttcaggtgactcttttatgtcaagttgacaaacactaggtgtaccacatcttgggagcctctaagagttaatgaaatgggtctcaagtccctagaaacgttgccaatatgccttatgtcctgacttgtcatatctcctttggtgtttgtatgtggtgcagaaccctgccatttcaagatttactctggagttgccttcgaaggggaagaactgaacgcgaccttcgtgcagggagcagatgcgtgccaagagacttgtacaaagaccatccgctgtcagttttttacttactcattgcttccccaagactgcaaggcagaggggtaagggaacctttctttaacgataatcagcaaggtaatttttttctagttttctctctctgtgggtttaattttgtactgttcatttttttccaggtgtaaatgttccttaaggttatccacggatggctctccaactaggatcacctatgaggcacaggggagctctggttattctctgagactgtgtaaagttgtggagagctctggtgagtgaagctcacttgttatggaactgcatggctggcttgactgctgtgatgaatgtcttggtcttatataatgggattgtttatatggtttctgttatggtttgtatgtgcttggcccagggtgtggccctgttggagtaacttgttggagtgggtgtgtcactgtgggtatgggctataagaccctcatgctagctgcctggaagtcagtattctgctagcagccttcagatgaaggcaccatgcatgcctggatgccgccatgttcccatcttggcgataatggactgaacctttaaacctctaaaccagctccaattaaatgttgtctttataagagttgccttggtcatggtgtctgttcgcacagtaaaaaccctaactaagacagtttccttggataaagggagggaatgctgatctgtgtctaattctgccacacatctcaacacttttcagactgtacgacaaaaataaatgcacgtattgtgggaggaacaaactcttctttaggagagtggccatggcaggtcagcctgcaagtaaagttggtttctcagaatcatatgtgtggagggtccatcattggacgccaatggatactgacggctgcccattgctttgatgggtaagttttcgatccatcttattttaccaatgtgtgtgtgtgtgtgtgtgtgtgtgtgtgtgtgtgtgtgtgtgtgtgtgtgagcatgcacgtgtatggacccttacctgcacatgtgtatataaagaggttagcctcaggtatcttcgtgtactgcttgcttttcttatttgttgagacagggttgttcactgagtctagtgctaacccttttgactagactggctgcacagccagtcccagagatctgtctgcctctgtctcccggcacattcttagccctagttcagtgttggggctctgaacttgaatgttcatgtttgagaagcaagccctttgcccacttagccatctccttggccctgaggcatttgttttgatgataataaaagtttccaagcctttgtctagaaaatattatgattttaaatttagcttatatatcttttacatggtcaatttaaaattcaaaagatatgtaggtacattttaagcaacaaaataaccttaattcctactggggcttattttaatcgttacagctgcttgatggctctgatgtaatgaaagcaattgcttttaggtctggtaaactgaacttaattctcctaaagcttcttcaaaaggcacagaagcattcccgtatttttacttgtaataaatataaagcaattgttaagtttgttttgagtattttcaaccacagcttttatactgtgctctgtaatcctatatggacacagttcagctgaatatgagcccctcaaagattttagaaacagtaaagggatcctgaaggaacactgaccaaaattcaatcaaaataaaatgttatgacaaacctgaggcattctgagaatcctctcctgtgcatatttcaggactccactgggtttgtaaacatacaacatgcttactgtgcactgtgcatgccaccatgctgtgtagtaccaacagatggtaccctaaagacaatcagactgaagattatgtaatgttgtgaaccatggtgtctgtagtacgtgtgccttaggttttctgctcttacaaaacataagagtttaatttcaaagaacaaaagcattaaaatgtgtcttgtcacagtcgcctttgggttgtacagtgttaaactttgattttcaacattgtttcataaaaactcattgaatgaacttgggtttgggtattagagtttccaaagctttctaaatggtccttaatctaagactatcatttggtcctccatatgtatgtgaagtggtgttcttagcattatcagttataaaagtaaaatattaagaaactcttaaaagcattgaggatgttctttgtcttatagtatcaaatattcagacatattttaattatgtatgtcgacataaataaacacgttattctattaagatgtgcatttgctgataagtggtaaaattatctgtgcaccaaaaattgtcttgtagtaagtttctttataatatatcatcagtaaatgtttaatatgtgtgcctgcttcatgtaatcacacacaaaaacaaaaaattatcttttcaggcaaaagggagtctcacatggacaaagttttattataaactaaatcttcgaagtccaatactgctgctgtaaacaacaataggtggccttgccagaaaaagtaactaggtcatatggaatgttttcgttcttctccctcctccccttcaaagaaatgtgctaagaaaaaggagcaaggaaggatgccaacgttactttgttctcctgcttctctcctaggattccctatccagacgtgtggcgtatatatggcgggattcttaatctgtcagagattacaaacaaaacgcctttctcaagtataaaggagcttattattcatcagaaatacaaaatgtcagaaggcagttacgatattgccttaataaagcttcagacaccgttgaattatactggtatgcagcgtatttaaggggaaactgtacaattcacttgtattggcgttagcttccagttcaatttgagcgagaagacagatctgcagcaattgtctttgtgtcctggttggtggggctgagggagagatgaggctgcctgggaagtaaaaaccccacgacctaccatgcatttgctgctacttaagggggcaaaagagcttcattactttctcagagtgcaacggagtgtatggtattgaaacagttggtatagggaagattttgacatctggggacattgggtatcttttgacaagattggcaggatgactcttgcttgggcttaggaatatacaactatatgaacatgaatgggactagaggttagtgcctaagaagacactgggctgacagtggaggaacatgaagaatggaactgccattggtggcacatcactccacagaaacagaatgcctgccaataccattagctgcaagtgtctgctaacagtcatgtgtccttagacagctcgcctttcttccttccacctctaatatccactgtatgtgtgctgactacttcattgctttcttgcaataattaagcaagatattcaagtaaaataccaggacagcatggctatgtttgctctgcttctgaattctgttacagtgtaggtttaccaaagcataaggatgtttaccaatacattttggttgaagagtccctcttccccatggaaatttcattctgaaatgccattcaaactgtgagaatttccttgaatcatgggctttagaaatggctggagggccattctttatactctttagtttcagcaatggtttcattatatctcatacatgggcatggtatgttttgattgcatgcacccccttcaccctctcttgcccttcccactcctgttgttcgccctactcctcccgtgtagtcccacatggctcattcttgctctgttgctttgtagaaaaagaataaggcaaaagatagatattaatttttcagatccctatctatggttttaattagcctaaatctattcatgaaattttctttcagaattccaaaaaccaatatgcctgccttccaaagctgacacaaatacaatttataccaactgctgggtgactggatggggctacacaaaggaacgaggtaagcctggcatgtggaatgttcctctcttatgtgctaaggtacatggagtagagccactcaacaacccgtagtcatgatccttctgtagatccattcaacagcccttactcatggcctttctgttcattccaaaatgatcccaagaatatgacttttttgcattaaaaactgatgagctaatccattaaacatattactcataatagagatcattttcatgactctgcatcaagaactgtaaccctatggtgctcttaagtccactgaagctcatctgatccccagttctcacagcatccctgtttactatgctctcccttgctatgaatagccaaagtgccagcatctctttaaggacagtgccatatatatatatatattatagtatagtagtgccaaatatatatatttgtagtataataaatctaactttccctctaattatgctgttaacttcttgtgtaaaatacatagattcataaagacaagtagattgcagcacaattgccattatttttagcagaatttcacacagggataaacatacatctgtattaatgtaatccttagcaagttgtttgaatatctaccataatgtttaaataactatgcacaagaacaatatcttcctttctgttgtaactacaattcaaagaatccgtgactcttacacagcagtgctggtgacaatatcacacttccgtatttgttatctgcatttgaaacagagggtggggttcagccttacttggaagggagagactgtagaggccagtttttctccttcccttcctcggagtttatggatagatcagttgtatgcgtggctctcaaatcaagggatctgtgtgttaagacttgagacatttctctagaaataagcatgttttccttttagactgagtgccagatagcatgtttgagtgatttttttaaaaaaagagatgattggctgtgtcttctttatattttctgaaccagttagtactgtattcaattaatcctcattttcactatgttgacttggctacaaatacgtggacacacacatatacatgtgtgcacatgcacacacatacacacacatacatatacacacatacatacatacaaccaagaaatatagaaatgggtgtagaacaaaatacttctctgctgttaaatgtttgggatttattttcataaattgtatatttgtgttataatttgaatttataaaacaatgaaaggcaagagcatccacgtattaaaggtacaaatgtttaaaacaacatatttttctgaggagagccttggttgatacaggaggatggctgagatcatagaaaccaagtctgtggtagcttgggtgataggggagcttcagtcaacacagatcattgcttcttcatctccatctccctcccctgctctccctccacttcttgcttcctttctccctccctctttctcccctacttattgtatttcctctctttaatgctacttcctgattgcttcataggtgagacccaaaatattctacaaaaggcaactattcccttggtaccaaatgaagaatgccagaaaaaatatagagattatgttataaccaagcagatgatctgtgctggctacaaagaaggtggaatagatgcttgtaaggtaactctgggaaaaatacgtaatagttcactggagactgctcatccaaaagcaaatttcccaagttacatttcattagtttcagttttgaagttgcagagttaagtgacatggagacttttttttttttaaagatttatttttatttatgtgagtgtacactgtcactgttttcaccagaagagggcatcggattccattacagatggttgtgagccaccatgtggttgctgggaattgaactcagaacctctggaagagcagtcagtgctcttagctgctgagccatctctctagccccagacctggagactttttaaacagcctttaacaaactaaacacacacaatgcacatcatgtgttccttataatagttacgttagaatttgtattgactgtgacgggtgtgtcacagtcagtacagggacatgccatatttaaggacaattttacatacatggtcatgctaaaatacaaggaaacagatttatttgaactttgggtaaagatgctaaaattgttgggtttatctgagaacgggagagggaataaattggccttgtaaccatccacttactttcttcatggctaatggggtgcagagaaattgagaagttgcatgtgtgatatgtaaaatatgatagcaaaatgttaaagacatctatctttgaacaaggggctcctaatttgaatcatcactgttatagctctctatcattttttttctactcactgtgatccagggagattccggtggccccttagtttgcaaacatagtggaaggtggcagttggtgggtatcaccagctggggcgaaggctgtgcccgcaaggagcaaccaggagtctacaccaaagttgctgagtacattgactggatattggagaagatacagagcagcaaggaaagagctctggagacatctccagcatgaggaggctgggtactgatggggaagagcccagctggcaccagctttaccacctgccctcaagtcctactagagctccagagttctcttctgcaaaatgtcgatagtggtgtctacctcgcatccttaccataggattaaaagtccaaatgtagacacagttgctaaagacagcgccatgctcaagcgtgcttcctgccttgagcaacaggaacgccaatgagaactatccaaagattaccaagcctgtttggaaataaaatggtcaaaggatttttattaggtagtgaaattaggtagttgtccttggaaccattctcatgtaactgttgactctggacctcagcagatcacagttaccttctgtccacttctgacatttgtgtactggaacctgatgctgttcttccacttggagcaaagaactgagaaacctggttctatccattgggaaaaagagatctttgtaacatttcctttacaataaaaagatgttctacttggacttgatgggacagagcaccttttcatataaaccacctttctggccattgctgctgagtcctgcatggtcatgagtaaggagctcgtgacagggtttcccacccctggagcaaaaccagctagatgttaggcttgtttgtataaatttcaagttcctcctttgggaagtattctctctgcctagattattgggggaatatcctctctgtcagggcagcccttaagattgtgggaaacatgagaatatataatttctctacaatgcaaaatataaggatacagtctgaattatataaggagatccatggacctaagagaacagaggcagctacactatgagccagcttgtcagaaagatactactgaaggagttaaagagataaagagatttggggaatagctatcacagggcaagatcccacccagctaagtttattatttgtgtttacaaagacagccagattcctgagttcaaggtcatcctgggacagagctggtttaggcccagggtaatgggggtcccactcagctagcttattgtctatgcttttaaatgcaggcagatttctgaattcatttgccatgttaaaaaaaatgtacctgatgtcttttcctaagatatacgggtctagagtcatggaatgctgattcatgggttaatcaaaagggaacctagagtaaacgcctgtactgatagatacataaaagtctgggctttggtctacaaatgttgagctatgtggatgagctgtgtagagctaaagattgaacagtggtctctaattatttttttagattatttttttctagcagctacccagagagaacggcttagagagtaaatattgctattttagatttttttttctagaaaatccaagaatttttatagcagcttttctgacactggtcagaaaacccatgagctatccagaaagcttttagatttttttttttcaagagagaactgtctcaagtagagacagctctctcaatcagagagagctgcctggagcagaaagctatctcgatcagactacagagccaagagctatttacaaagagctgtctagggagccattttaagcaggctataaggctgtcagcttgcaccccatcatttgactttgagttgtttctttcaccactctcaaacaccccttctctcaggaactcctctccaagccaagactggttcttggcacattgccacatggtcttggctacgtatgcatgtaagacctgtagggctatatttttcttcttgtgtgcagctccaacaataggcttatcacacagtactcatacagggcacggaatctgatgagaatctcccccagggaaccctttggagttcggttgatactgtattctgcaatagtaattcatggaatgtcattggatgtaaagtgttgtataaaattcaggcttgtagttgagttgaaagtaaaaagcaatcttggaagggatgacagtaatcctcatgtaagacaaatttccagcttcccagtgattcataaagtggaccatatgggcttaactccatttagttaagctgattaatatttagaattagccatttacaaactattgtgcaagttaaatagacaaacagaaaagtgaaatttcctaaagaagattaaacctttcactgcaaaggtttgttgagtagtgcagaggattaaatatggaaaagccagtgggttatccacagaatttgccacgggaagtggaggaggtggttattatctgaggagcaaataaatggcttttgtaaaatctgtctggattcccatgaaatcactcccctttaaagcacaccacttcaacttttaattttgtatacaatttcatcttaatctgttctgtgtggaagttattttatatttaaaatgaaagaagtggttctcaatgaaaatcacgtatctcaggatttcatactgataaccctaacaggtgttcacacaaggtgtcagagtgctggctgggtagaccttgggctttggtttctcaaggaatggcctcatttgatctaaacagttttgaaatgtttaatttccctggggcataaagtaacattataacattgccagtgggagtccagttagattggaaggctctgtttattttttgttgtgtgttccagcacaaagtagcctgtcttccacttggggccttatggggctagtgagaaagtgagaggcttgaataacatcactgtcacaaggcagagaggaggcaggaggccctagatctttggcaggtccatccaaaaaagggagtgttatctctgggaaagaacacggttcttcctgggtcacacatgcagaacacactgcatactgttcacatgtgtggagttcaacccaaagctcagagggctgtctctcatcgttgacttttcttcttgtaattcttgcttatgcctgccagccctatagattgtcagtaactaggaaggaggttctccctgactctgtctctctctttcatcaatactacatgtgaatgagcatgtggcacatgtctccctttagatttacctttattatctttgttgatgtgttgtttaattgtatgtcacgtggttgctagtgcctgacaccaactgatcaaagcgtaacttctgagcaactgccttctaccagagtaaaatagagtagtccttcatgtcaagatctcttcaaagtcatacacaggcacacacacatggacacacatgcaggaaagcatggacacacatacacatacacatgcatacacacgtgttgtagttaccattattttgagtgtttactataccccctttttgcctttaactatttattaggtatttctaccctactttagataatttagttcccaaataaaagacacaggaatctttggatttagaataaactttagagcactgggcagatatcaaccctctatgctatcttgtctgtttccctatcaaattgctggagatactactt

SEQ ID NO: 16 - skipped

SEQ ID NO: 17 - DNA, 2353 bp, Macaca mulatta
ggaagccgttcactagtcagattgaccagagattatgggtgggctgtctgttggggtctatgcacaggatttctgttggagttctaaggacaaaaagttgaaactgttggcagaaacccaaagtcaatatcgaagccaaggaaaacattgcctgcggtgccacattagaacagcttgaagaccgttcatttttaagtgacaagagactcacctccaagaagcaattgtgtttgcagaatgattttattcaagcaagcaacttatttcatttccttgtttgctacagtttcctgtggatgtctgactcaactatatgaaaacgccttcttcagaggtggggatgtagcttccatgtacaccccgaacgcccagcactgccagatgatgtgcacattccacccaaggtgtttgctattcagttttcttccagcaagttccatcaatgacatggagaaaaggtttggctgcttcttgaaagatagtgttacaggaaccttgccaaaagtacgtcgagcaggtgcaatttctggacattccttaaagcagtgtggtcatcaaataagtgcttgccaccgagacatttataaaggaattgatatgagaggagtcaattttaatgtatctaaggttagcagtgttgaagaatgccaaaaaaggtgcaccaataacattcgctgccaatttttttcatatgccacacaaacatttcacaatgcagagtaccggaacacttgcctcttaaagcacagtcccggaggaacgcctaccactataaaggtgctgaataacgtggaatctggattctcactgaagccctgtgccctttcagaaattggttgtcacatgaacatcttccagcatcttgccttctcggatgtggatgttgccagagttctcgccccagatgcttttgtgtgtcgaaccatctgcacctatcatcccagctgcctcttctttacgttctatacgaatgcatggaagatcgagtcacaaaggcgagtatgcatggctagcacttgctgctgtactttcatcaattttattttagaaactttacctgaaccctgccattctaaaatttacccgggagttgactttggaggagaagaattgaatgtgactttcgttaaaggagtgaatgtttgccaagagacttgtacaaagatgattcgctgtcagtttttcacttactctttactcccagaagactgtaaggaggagaagtgtaagtgtttcttaagattatcttcggatggttctccaactaggattacatatgggacacaagggagctctggttactctttgagattgtgtaacactggggacagctctgtctgcacaacaaaaacaagctcacgcattgttggaggaacaaactcttcttggggagagtggccctggcaagtgagcctgcaggtgaagctgatggctcagaggcacctgtgtggagggtcactcataggacaccagtgggtcctcactgctgcccactgctttgatgggcttcccttaccggatgtttggcgcatttatagtggcattttaaatctgtcagacattacaaaagaaacacctttctcacaaataaaagagatcattattcaccaaaactatagaatctcagaagggaatcatgatatcgccttaataaaactccaggctcctttgaattacactgaattccaaaaaccaatatgcctaccttccaaaggtgacacaaacacaatttataccaactgttgggtaactggatggggcttctcgaaggaaaaaggtgaaatccaagatattctacaaaaggtaaatattcctttggtaacaaatgaagaatgccagaaaagatatcaagattataaaataacccaacggatggtctgtgctggctataaagaagggggaaaagatgcttgtaagggagattcagggggtcccttagcttgcaaacacaatggaatgtggcgtttggtgggcatcaccagctggggcgaaggctgtgcccgcagggagcaacctggtgtctacaccaaagtcgctgagtacatggactggattttagagaaaacacagagcagtgatggaaacgctcggatgcaggcgccagcatgaggagcagcccagagtcttggcgagttttacaacctgggttcaagtcaaattctgagcctgggggtcctcatctgcaaagcatggagagtggcatctactttgcatcctgtcataaggacaaaagacagtgcactcagagctgctgaggacaatgttttgctgaagccagctttcagcattcagtaactgggagctgataatgtgaagtcgcaaccgagatctccatgattgtgtgtcgtaaaat

SEQ ID NO: 18 - DNA, 33001 bp, Macaca mulatta
  misc_feature (17364)..(18312): n is a, c, g, or t
  misc_feature (23228)..(23609): n is a, c, g, or t
actgttggaaagacatcattggttttgaaatctgaaaaggacgtgagatttgggaaaggccaggggaagaatgatatagtttggctccatgtccccacccaaacctcatcttgaattgtaatccctgcatgttgaaggaggggcctggtgggaggtgataggatcattggggtggtttcccctgtgctgtgttctcatgatagtgagggatttaaaagtagctgtttcccctgcacatgcacactctgtctctcctatcaccttgtgaagaaggtgtctgcttcccctctgccttccatcatgattataagtttcctgaggcctccccagccatgggtaaccgtgggtcagttcaacctcttttgtttataaattgcccagtctcaggtagtatctttacagcaatgtgaaactgaactaatacatctgggaaattctttttctctccttcctttctgaaggacagctttgcctgatattatattcctggttgccaggttttgtactttcagtactttgaatatatcatcccattctctcagcctacatgatttctgctgagaaatccactgataatcttatgaagcttcccttgtatgtgaagaattgcttttctcttgcttctttgaaaattctctctttgtcatggtgaggatctctttatatttaatctattggagttcttttgggcttcataaatctggatgtttatttcatttatgtctccaaattttgagagttttctgttcttatttttaaaaataagtttctgcaactttctctttctctgcttcttctggaactcttgtcatgcatattagttttcttaacagtgtcctgtaatttttgtcagctttctgcaatctttatcattccttttattactctgactgggtaatttcaaatgacctgtatctgagtgtgctgatcctttctcctgcttgatcaagtctgctgctgaagatgtttgtgaattttttcaattcagtcattgtgttcttcagttcgagaatttctgtttggttctttttatggttcctatctatctttttgttgaacttctaattttgctcatgtattattttcctgattttgtttactgtctatctatattgttttgtagctcactgagctttcttaagataattatttttaactctttgtcatgcagtatagatctccatttctttagagtcgcctcctgctgctttattttcttcctttggtggtttcttgtttccctgattatttgtgatcagtgtggccttgcattgaagtaggtacctatttcagtctttacatactagcttcagtagaggaagccgttcactagtcagattgaccagagattatgggtgggctgtctgttggggtctatgcacaggatttctgttggagttctaaggtaggcagggctggattctgggttcattcattgtggttgtctgtattctgtgcacaaggactggcttgaagcatggatccttgagggctgacttggcactgaaatgagccttaagcctgagtctgcaggggccagcctaacatggggatcacctagcacctgagttcatggggacagacctgttcctgagtttattcaggctgtcctgggaccagggtccactggggtgagcccagcatctgggtccacatggccaagatctctggaggctgacctggtgctggatctgcaggggatggcctgaattctaggcccatgggtaccaacttggagccttgggctgctggggctaatgtggaggctagagtcttgggggccaggctagagctggggcaggtctgaagtctaggtcttctgtggccaccttggagtctagacccccaggggctgacctggtctggggtgagcatggggctgaggccacagaggccagtctggcctgtggcaggcctgaatcctggtgccggggtttactggagtgggcttggtgcttggggtctgtggtgaaggtgggtgctatcttaactgtctctcttccacgcaagagggtatctctctccatgctgtgctgcccaggcttgaaggtggggtgacactggtaatgtgaaattgtccttcctatgcacttcaatgtgtcttttcttacttctgtgctgcaactgggtggtacaacctctcacctgattcctgagctctagtgaagttattttcgtgcatggatacttattcaaattgatgtttctgcaagggatgagcactagaaactcctgttctgacaaactcctattccggttcttgctgacatcactccctgaaatagttaatatacttaacagctgaacacggataggatgttcacggaatatgttgacaggacaaaaagttgaaactgttggcagaaacccaaagtcaatatcgaagccaaggaaaacattgcctgcggtgccacattagaacagcttgaagaccgttcatttttaagtgacaagagactcacctccaagaagcaattgtgtttgcaggtagcaaatttctattattctgattgtttccaaagaaactataatttttaaagtatagttttttactttatgagaaaattagtcatttatattctaatttcctgagtatatagatagtagagaaggaactaatattcctttatgtagaaatatttaaatgtaagatgactttaaatcaaaaagaatacttgattgatttaaaatttttaattgggctttaatattttcagaggttttctttacttagggatttttggactgacattattgccattatttattaattttctttttgctcaaatcaagaggtttcataactgtttaatctctctctctaccaattccctttccaacattactagccacagagtttgccaatcaacaataaacacaacagtagtctggaggtctcaatttgtatcttgggaagcattataaactttccaactccctagacacaaatgtagagaaaaaaccccttgttttctataccagaaactgtgtgctttgtcttgtaattcagacatttacaagaaaatctgtatcaccttaaattaagatttatgttaaatgcagtctaaaaccaacagagttatgtattgttttcttttttagaatgattttattcaagcaagcaacttatttcatttccttgtttgctacagtttcctgtggtaagtgaattatctataaagcatgaaattcaggctaagacaggagtagccaagcaagtcgcaccacctctggagaaagctattgaacatacagcttcggggatggagatagtccctgatgattcaggacacgtgtctatttaatgttccagaacaagtacgacttgtgagatatattgctgtatacatacattgcagaccagaggaaggagctcagaagcgggaatgtcttgggacttgtgttaataaaaacttctgttcacagatgacactctgcaaaacaaaactcaaaacaaaaaaattactcctctatttttatcaacattaaaaaattaaacattatctgaaatttcaaaagagtgctgggcattatatagtgtctgggtccaatccaagtatctgttaggtacatgatacatagttttactctggacagccagggaaccatttcaaaaatgaaagtacctggtttaaatttaacttagcaaaccaggcatttggatagttctaggtgaataactttcaacactagatttcgatctcatttctctattaatatcattaatttttggagaataaaaatgattctggacatttcattaatcgctatagagggagttttctctgtgtccccacaaggcatgattctgagtctatggtgacttaagagggccacataacaatgagtatttaactttcctctcgtatggctacaataaacgtctacagggaaggtttacattcataaagagactacttttccaggaaaaaaggctttgattccccctaaatcacaactcccctgtgtctgtccctcaaccctgattgcttttctaaaccgtaatttaccaacccatgtgcaaacccactgaaaactgaaaaggagcatgagccagggatactgtgaaccacggccacctccaggtggtttctcattttctgtttttttcttctggcaaaataaatcatgattatggctaggaaaattaaggatgtaaataagcaaaaaactataaactacatattgcatgtagtccccaaattcagaagcagtcgttgttaaacatcttttgtttagtctttcagatatttttctacatatgcctatttgcacattttacaaaaaagagttattaactatggatactctttgacttgcattttccacttacagctaccttttggtgcaaataaatgacattttttggagcttgctattctctttttatggtatgtttgtgtgcacattcttatgcacttagttatttctgtagaatacattttttgaaataaaaatactagattcaaaggtatgaatattttagaaggttttatggtgtggcatcatgaaattatctttcagaaaagttactccctagttgacttcttctaccagctaataagagtccttatttaccccacttaggccaacactaacaggcttctgttgctttgcatcccgacatgtttatctttctggaaacagtatcctaatttatttctgcagagctactgcctctcagttttggtccatgtggttctggtgaccctgactcttctgctgaaccaggaagtgcacacatcctgctgactgcagtgacccaatcagagccaacatcttgcaatgaagcgtttgtttagacgtctagaaataggactcttacttttttttttccaatttaacttgaaacataagagaatacagaggcctgagctgctggtcctattttgctactatgtggagcttgagagtaatggtaacaccatgactggagcaagcggaaggagactattgtccactgatgctatccgttgagcacaatgtggggttactccttaagccagagtcaccatgggctttttggctcctgaaccaatagatttcatttgtattcaagccactttgtactaggttttccatcatttgcaatcaaaaccagtatacaaatactggttatttaatttttcatttttactaatctcatggaaaactggcttctagttgttttaacttgcctgtatttgtgattcttcccattttcgtgtacttactaatcacttctatttcttttgtaaattatcttttcatatttgtccactaattctttaaaattagagtacttttcttctccttattgtttatgtaattgttaaacaagactgaataacctgcccaaaatccgtggacatgggagcccatgtgaaagctttgaaagccaccatcattatgagataaactatataacagtactttacatatgctccaaaatacagtacagacacggctatcattgtcatgatcatgatcatcattatcagcatgatcaccaacttaggaggataagcaagaacacctactagaagtttctttccattcagcaacaaagttggcgtttttctagtcactcccttccctgactgagtcacatggcaggtcacagaggctcaatggcagaatgggaagctctgggccagcaccagccattgtgtgcatccttgcgtgtgaacctaggtgctggaagaggagtgactgcttgataattatgagtcagtcaaaaccaccaactgtctgacaaaacagacctctttgtaacctgtattgtcactaaaccaatgcctccatgctttgtgcatacatgaaatctaggcaatacacttgtattccccaaagcttccatttgaagagatctgtgctcttcccaaatgtaaaccttacccgagaggtggtcatctggccgcacctctgagagggatagaagtcttgctgtgttgggtggtcagactggggctcagggccagaattcccagggggtaggattgtgcagagaagatggcactctccagtgcttaataaaatgcacgtggtctaagttgcccattccctcaaaggcaataaaaaaataggtactatttaaattgaagagtaactactgccccagcgaatggacaggttgtcatcggaatagccatggttaatgccccagcgaatggacaggttgtcatcggaatagccatggttaatgccccagcgaatggacaggttatcatcggagtagccatggttaatggtcagttgactgactgaaatgaatatgctggctgaccaggaaagctcattaagcagacttggaagagagtctttccaggtaaatccacatttacaaattaaagcagtaatgacacctaattctctaataataggtggggtgcagtgtattttagagctgggaataattccaaacagcaaatagttcaaaatttattttccatttagcatatgcatgcatttgcttaaactatcttaaaaatgagtaaaaaatattgtcagtttgcttgaatcatactgagatgcggaacaatatttagcactgcatgctagaaaaggacacaggattgggagtcagggctgggtgactgtcgcaggattttcattaagtgtgtggatcttgggcaagtctgtatgccctgagattcagttatttaactttctttcaaaaaacctaatccagatgcagataacaaaacctgcttctaacttcccttacagaattgtgagaagctggtggagatgtttgtaaccaaagtgttttgaaaatagagcaaatattattctttttaaggcatgatattttcatagcatgtcaggcaacagggaaaaactaagttaggattttattttattgtgggtaatttatgtgcaaattttggtgcaatttaatgaaaataagccaaagttttaatgcagaagtgcccagaaaattaaataacaatctacattgttcaaatggttgccttaatatattttattttctcagcataattagaattatattatacaggtcttggagtagtcagtcagtgggagaagttaagacaacagatatctttttgttaaaattattatttgaattatctcaaattaacttttatggttctatcacaggatgtctgactcaactatatgaaaacgccttcttcagaggtggggatgtagcttccatgtacaccccgaacgcccagcactgccagatgatgtgcacattccacccaaggtgtttgctattcagttttcttccagcaagttccatcaatgacatggagaaaaggtaaaagttgatatttcattattggagaagccatttttctaaactgaatcggttttgtgcaaagaggtgtagtataactgagagttctgtctcagacggggctcaaggaccagcttcagcaaaatcccttcaagtggttcttaccaatgcagattcctcggcaacaacccagatttgctgaaccaaagtttcttgggactagaaattgcattttaaacaatcactgtgtttatttaaagtagtagaagttagtcattttctattcaaagcctcaaaatgcttgaacatcgttgggctaagagattgtctccagaaagcatctaacaggcgaacatttcatctgaataaagaaacagacttaactgtgtgacccgtgatcacattagtggctagcacagtccgaaggaaataacgtaagacaagcattttgcggagaatataattgagaaacatctagaacttgtgattttgggacagggcagatctgaatgacgcctaaagtgagccagtttgggcacctatggcatgatgctatgtatggtatgtgtgtgttcatgtgtgcttgtgcttgtgtgaatatgtattattaactggagatttgtaaaagtattggaaaaatactacttatgattttttttttttttgagatggagtcttgctttgtaacccaggctggagtgcagtggcacgatcttggctcactgcaacttccgcctcccaggttcaagcgattctcctgccttagcctcccaagtagctgggattacaggcacgcaccactacatctggctaatttttgtatttttagtagagacggggtttcaccatattggccaggctggccttgaactcctgaccttgtgatccacctgcctctgcctcctaaagtgctgggattacaggcgtgagccaccgcacccggctgtaattacaatttttattacatcagagagatgcttattaatcacaagctacagtttcatcttaatgattttcattttgaataagaataagcttttctttgttcttcccatttccatattcataactcttttctcatcttctccacgtgagtttgtgaactagaaattggatagtcattctctgatcctacatgttaaacttgtagagaaaacccagattgtatgtgaggatcatcatcttaaaagtggaggtaggttctagaattcttataaataatgaaattaacatggaggctgacatttgagacagagggaagtctttcattaagtgcagactacaaggagttaataagcaagatgaacacacaatatacagatccagctcttatcactaagttaattttttaagtaaatgaaagtatttgcaaaaataattaccaattaaggacatagttgcctgaaggtttaagaatacaggaaaagtcattaactcttcaatgtggttgacttcctgtacttaaaaaatgtgagtgtaaagaaaacgcaatgctgaagttaaatattatggggatgttataaaattacctctaagagtgttctttccagcaagttttggggaagctatattatttcccttattcctggttttatgttagtgtatagaaaatgctagacatttcctcaatgtatgtttgttgttctacttcctaaataaagctacttttaaaacaggtttggctgcttcttgaaagatagtgttacaggaaccttgccaaaagtacgtcgagcaggtgcaatttctggacattccttaaagcagtgtggtcatcaaataagtggtaagctgcgaatttcttagctacatttgagttaatattgaatctaccttagaacagcttttgctaaaagtctgtactgctacagcctttgggaaggaatcactcataaagatagaagatggggcagtattctggacacaaaagagggacccatattcatctggacacttctgttgtctttatcaatcgacacgtatttaatgagcctctattatttatgaggttagcactcaagtgtaagatttgcagaaaatgaatccaaataatcgtgtctccttgtttccagataagaatttttaagaaaacacgagggaacatctctctcaggttcacgtgagggtaatttttatatcagtgattctcaactggcagtgatttttgtctcttccattaggggacatttgacaatgtctggagacacttttggttgctatgactagggagggcgttattagcatttactaagtagaggccagaatgcctctctcatttactaagaagaggccagaacgttcgaatgctgctgcccaaccttctacaaggcacagagcagtcctccacagcaaataatcttctggcccaaaatgtcaacagtgctgacatcaagaaactctgatataccattaggcccaaactgaagaactgggttctgcaaatcttgctaagaataatacttcttaaaggaaacttgaggactaggatgctagagaactttgattttacatctgaagctactgatgtcttgggaaataatttccaacactatcctaataaatttaagacaaatgaactatttctcaaacatgactgggactgatcagaaagtgagaagtgctgaaaagattcaactgatgggttgtcggaatcttaaaatagctgtgctgtgattctatgtgtgactatacatcataactattttatttgtattatgcacaattaattttgtaggttcaaatttcagatgtttttaaatttgtcatcctttcctccctcattgatatcaccccttcgatacatacacactttgagcctgctgtttgcatgttaaccagttatcaaaggatggcaaagcgttcgttatgaatatgggcctgacttagccagtgtaataagtgtagtctacctgaggtggggtacatttcctgttttataagaccaatgtgtatgttcatctaatttggtataaagtattcaaggaagtgctgtttccaattgttgtatcttatagcaaaatttaaagaaaaagtaacattgtgccttccccaatattcctgttattgttaatgtattctaaaactcagtgttactcacttagcttgcttttaatgtttttttctaacttcatcatcttaaagtgaaaaattgttcccaagtacataaaatctctactttcaggaacaattctagtcgaaagcatttagagctttcacatgaacacttacaaagttgttatttgtgagagtcccatcccaactcttagcctactcttttctcacacgcagaaaaattggaaagagatttcatttcgaccgtctgcaaattcctgtgtttaagaaccactgtgaataatccacctccctacccaattcccaattcgacatgcagttttcctgacagtttgtatgttttctgtctttcccacccttaaatttagttttatgacttcaaccacacttcttaggagtggaaagttacctgtaatagattatggtttattccacataatcttggggaataaaactttaaaaaagtttatggtttagacttctggtttacattacttccttaaccaaaagtctaactaagaaatttgaatatttaaaaaaaaaaagagcctaattttgcttccttgtctgtgaaaagaattatctatatcttttgcatgtaagacaaatctcagtgaaaagggtgcttaaatagaagttaacactattttaaagcaagaatggaagtggcttcatcatgcataaacaacaactctccacattttgtaacgattgatccagatgcaatttgtagtcagacaggagaagttgaaagcagagaaagaacactgggagatagagaagctccttcattcaatgcaaaaggtcaaaggcacatcagtttctttaataatgcaaacctcagcacacatgatcagtgtcctcattattattgccttgtttatttcccactgctcactgttaatttcaacgtgaaatttacctgtattgctgcatgcatcttgcagtttaagaagcgaagtaacccaatttccaagctagtgctttcaggaaaatactggattgtatttacttcgagcagagtttgataatttatggacatcataaaaattttaaatcccttaattaatatagcaattgccaaaactgggctgttatccttctaaactaccggcccaaatggtagtgggatccttctaaactaccagcccaaatggtagtgggtatctaatctacctctagaaagaaaatggactgtgtttgctctatttcctttttcttgtacagcttgccaccgagacatttataaaggaattgatatgagaggagtcaattttaatgtatctaaggttagcagtgttgaagaatgccaaaaaaggtgcaccaataacattcgctgccaatttttttcatatgccacacaaacatttcacaatgcagagtaccggtgagtacaattcatggtgtttgttctttatattagtgcccccaggatttcactgtattcttcacaacctcttttgttcccaaactaaaaaccaaacagggcttttactcctaaccactttccttatttacttactctattttatatttttatcttctttttttttttttttttgagatggagtctcgcgtgttgcccaggctggagtgcagtggctcaatctcggctcactgcaacctgtgcttcctggcttcaagcaatcctccttcctcagcctcccatgtagctaggactacaggcgcccaccaccacacctagctaatttttatgtttttactagagacggggttttaccatgttgctcaggctggtctggaactcctgatctcgtgatccacccacctgggcctcccaaagcgctgggattacaggcatgagccactgctcccggcccttcattttaaagttaaataattcatttaatttcatttgtttctctactcttttcctctggcaggtaattgtaccccatcttcaaagcctggcatcctcttccaccacttctccaaaggctgattctttcaggtctttcctcagataccgtcccctccaaagggccatttctgagcattctcttttaagccacattcagctctgtttatttcattcgtagagctaatcacaatttgattttaacttgtgaatttctttccttatttttaaatctcgtttttgtttgcatagatgtatggggtacaagtgtaattttgttaccttggtgtattgtacagtggtaaagtctgggcttttggtatatccatcactggagtcacgtacattgtacccactaagcaatttgtcatcacctgcccctttcccacctctctatcgccttcccagtctctactgtcgatcactccatgctcttctcaattgtggtgtcatttttcctgaagcgaaatttcggtgtcattgtttctgaagtcattttctgacgtctgtgtcattttttgctttcctgaagtgaattttggtgtcatttttcctgaagttccatttgccccacgcataggccttacttgtagaatgagggtttagtgtcatggtgtctcctgcctcattctcaccccaactttcccttgacccctttgcgaggagaaggatgtccatttgattaataatgcaaacccctaacccactcattatcagcatcattgttttttccactgtccgtttgaatactaaatgttacctggactgctacctccgcctcaaagtgcaggaagcaaagtcacctcttttcttcccattcaggaacacttgcctcttaaagcacagtcccggaggaacgcctaccactataaaggtgctgaataacgtggaatctggattctcactgaagccctgtgccctttcagaaattggtaattgtaggaccacttcaccttgtgattgtagtaggcggaataggaccccccagagatgtccctgtgcggagccccggtacctgtgcgtgtgttcccatagctggcaaaagcgtttctatcaatgggattcagttaaggactttgagatggggagtttactctggatttcctcgatgggcccaatgtactcacaggattgggtgctcacaaggctaataagaaaaagggagaggcagaagggtcagaggcagagagaggtttgaaggtgttacactgctggctttgaagatgaaggtccatgagccaaggaatgcaagtggcctctagaagttgaaaagggcgaggaaacagtttccctgtggagcatcctggaggaacaagccctgctgatgtcttgattttagcccagtaagacccaatctctagaatggtaagataataaatttttgttgtttttaaccactgagtttgtggttatgcccctatagcagcagttataggaaactagtacagtgatattgttataggtacaatgatattgtagcaaaactgtaaggaccttccttggttgtgtccctatctagggaaatgactctaccggggggagggaaataacattctgtcgtgtcacacataaaggtaatttcaatggaattgtccagaaaattgccatgacattccacctcatttagcgtatcaggatgttaacgacaagatgttactgaaaccaaatcccttactgccagttctccgcagtagtgggtgctggctctgtgcctggccctgtattgggtgctgggctaggatttccctgtggaagattgggaaggttggttacaaggtgtctattttcctgtctcctctttgtgacagcacaccttctccacggtgcgtgccaggttcacgtgtactgatgatgtgattttaacgttcatattatttttttccgggagagtttttgaaggctgccaggaggcaggactcgatgcaagcatgctccattctgtacccagcactgttgctggaaggatttgctgcacttacccagggaacaggcaagctcatgccgtggttctgggctgtcacagctgctgtccacacctgggagagcaccctggatggctcatctctgtacttgctttcttgttaaattgcagtgagttcacatgtgatttaatctgatcaaatggcctttacagactggtaaaaatctggctgtttcaggcagtgttttgagctgctaaaggcatggcttttcactgagtacgtgttccccgttcctcagggaacacccagtagctacgtgcctcctcaacctggagtagggctgtctcctggcctcactgcccagatgagattcataagttagggatcatctgtagtcatcactacaggtttgtccttagtttcaccatggatttttctaattttacaaacaaaacccctaaggctcctagaaggagggcagaagtgaaggtgcttgggggtcatatagctgatgagctgaacgagaacttgacccttgggtcacacagatttcacattgctcactccccattttgattttttaatggatttaatggtgttttaaagtctcctgcctctcaactcatataaattcatcatatttacagatttccttctcttgcggtccatcttcctgcatagatcttgacagatgtcagggtaatcacatcttcccagttaatttaacaaaaccgtttgcaattctgatatgggaaatctaccatatgacttattaatttatcaattgaggtgataaacatatttttcaagccaaaagtaggagaacataaactggaaaaaaaagtttttttattttttatttttttatttttatcacctctggggaagaaaatctgataaatgaacctggttgatgaaattgcaattagtgggagcaacatcatggtttctgttctgagaataaccagatggtatacttgaaatagagaatgtcctagaaatcaactggttgcttggccaaaatatctataaatagtgcccgacatattagataggaaaagcaaagtaaaagcaattttaataggttaggacattgggctgaagtattgcatatatttaatgtcacgtgcatctgtgtgaagagaccaccaaacaggctttgtgtgagcaataaagctttttaatcacctgggtgcaggaaggctgagtccaaaaagagagtcagggaagcgagataggggtggggccattttacaggatttgggtaggtaacggaaaattacagtcaaaggggttgttctctggtgggcaggggtgggggtcacaaggtgctcagtgggagagcttctgagccaggagaaggaatttcacaaggtaatgtcatcagttaaggcaggaaccgactattttcacttcttttgtcattcttcagttacttcaggccatctggatgtatgtgttcaggcttaggcccagaggcctgacattcctgtcttctcatattaataagaaaaataaaatgaaataggagtaaagtgttggggtggcaaaaattttggaggtggtatggagagataacgggcaatgtttctcagggctgcttcgagcaggattaggggtggcgtgggaacctagagtgggagagattaagctgaagaaagattttgtggtaaaggttgatattgtggggttgttagtgggagcatttgtcgtatagaatgattggtgatagcctggatatggttttgtatgaattgagaaactaaacagaagacataaggtctgaataagagaaggagaaaaacaggtattaaaggactaagaattgggaggacccaggacatctaattagagagtgcctgagggggttcaacataattagttgcttggttgctgagtttttgggctctatccttgacagagtcctccttcttaagttggaggctgagcttggtgaggtgtgtttttaaaagaccattagtcctttctacctttcctgaagattgaggagagtaaggagtatgaaggttttactgactactaagagcctgagaaactgcttgggtgatttgactaataaaggccagtccattatcagattgtatagaggtgggaagtccaaaccaaggaattatgtcttacagaagggaagaaatgaccacggtggccttctcagaccctgtgggaaaggcctctacccatccagtgaaagtgtctgcccagaccaagaggtattttagtttcctgactcggggcatgtgagtaaagtcaatttaccagtcctctgcagggacaaatccccaagcttgatgtgtagggaagggagggggcctgaacaatccttgaggagtagtagaatagcagatggaatactgagaagtgatttccttggggatagatttccacaatggaaaggaaaagaggggttttaagaggcaggctagtggcttgtaacttacatggaagaggttacgaaatgatgacagaatagaatgggcctgtgaggctggaaggagatattttccttggtccaagaactatttgccttgtgtgggaagagattgataggtggaagtttcaatgtgggagtagatgggagtgaccgattagagggaggaaaaactggccgtgagggacagaagttggaatgctagctgcttttataactaccttatcagcatgggtgttgccttgagcaatgggatctgatgccttttgatggcccttgcagtgaatgactccagcttcctttggacgtaaagtggccttgagaagagtttttattaaagaggcattaatgatggaggacccttgcagagtgaggaaacctctttcagcccatataacagcatagtggtgcaggatatggaaggcatatttagagtcagtgtaaatattgatgcatagtacctttgcaagagtgaggacctgagttaaggcaatgagtttggcttgctgagaggtaagttaaggcaatgagtttggcttgctgagaggtagtggaggggtgcagagtggtagcctcaatgatagatgtagaagatattatagcataccctgcctttgctggtgggtggagattaggcctggtggaactgccatcaataaaccaagtgtgattagggtaaggaataggaaagacagaagtatggggaaatggagtggatgtcaggtggatcagagagatacagtcatggggatgggggccagcctaaaacagtaaggtcaagttgtttctacagaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcgaggagcagcctggggaggaggggagaggtcagatgggtccatagaaaaggaagattggaaagactcagcaacgcttggggttgggattgaggggacaggcgggagggaaagaaggaagatttgggatgagttgcattgggaacaaagactagggagggactgatgtgtaaaagactgcctggacatcaggcagctcagaccatttgcccattttacaacaagaattatctagatcttgtaggatggaaaaatcaaaagtgccgttttctggctatttggaaccattgtcaagtttgtattggggttaagcggcattgcagaagaaaataaggcgttttggttttaggtcaggtgtgagttgaagaggttttaagttcttgagaacataggctgagggagaagaaggaggagtggagggtggaaagttgcctatagtgaatgaggcaagcccagagaaaagagagggtagagacacggagagaaggggtcagggtgcttgccccccaggaaagtggtgcttgccactaagggtgaaggatcaaggcaggcatccctaaggtgatcagacacctctgaaacatgggcgcataatcaagcaggtgtccctgtagtgattaaatgccaagggaagactgtcttcccgagtccatgactggtgccagagttttgggttcacagataaaacgcgtctcctctgtctctaccagaaaatgaaatgaattgaaattaagagaagggagagattgaaggatggcgccaagattaaaaggagaaagaggttgagggatagtgagagagattggataagagagtaaaaagaggccgtttacccaatttaaaattggtgagatgttccttgggctggttggtctgaggaccagaggtcataggtggatctttctcacagagcaaagagcaggaggacaggggattgatctcccaagggaggtcccccaatccgtgtcacggcaccaaatgtcatgtgcacccgtgtgaagagaccactaaacaggctttgtgtgagcaataaagctttttaatcacctgggtgcaggtgggctgagtcagaaaagagagtcagtgaagggagataggggtgggccgttttataggatttgggtgggtaatagaaaattatagtcaaaggggttgttctctgatgggcagggttggagctcacaaggtgctcagtgggtgagcttctgagccaggagaaggaatttcataaggtgatgtcatcagttaaggcaggaaccggccattttcacttcttttgtcattcttcacttacttcaggccatctggatgtatgcgtgcaggcttgggcccagagacctgacatttaacatgaataaatgtgaagttcttagaatcatacatacacattggaaaagatggggtttaatagcactttataaggagacttgaagaatgtttgagaatccaccatgaagctgctgaaaatatcaagaaaatttaattcttatgtatataaataatgtgtctgttttacatgaattccctctatcaagtttggtattttaatatagcatatattattttttcatagtagatttaaaatttttgatgtataatttagataacataaaattaaccctttgaaagtgtacaactcagtggtttttagtatatccacctgatttcacaagaatcaccactatctagttccagaacatttttattaccactgaagaaagactgtatccattggcagtctttctccattgcctactcctccaatcccctgacaaccactaatctactttctatgtctgtggacttgactcttcgggacattttacataaatgcaatcatgcaatgcagcacattttgcatctagcttttttcatctggagtgttttcaaggctcattcatattctagcatatatcggtactttgttcctatttaggactaaatagtattctattatatgaataaaccatattttgtttatatacttagtttgatgaacatttgagttgtttctggattttttttttttttttttttttgcctcttatgaataatgctgcaatggacagcagtttttgtgtaggcatacattttaaattatcttatgtatatacttaggattaaaattgttggatcatacagtaactccatgtttaactttttgaggaagtgtcaaactgtttttgagagcagctacacaattttacattcttaccagcaacaactgagtgcttcaatctctctacaaccttaacaacacttgttattgtcttttttattattgcctttctaggcagtgtgaagtggtgtctcactgtggttttgatatgtatttccctaatgactaataatgttgtgtatcttttcatatgcttattatcaatttgaataaattctttggggaaatctctgtttaaatcctttagccattaaaaataattgggttattttgttttcattgttgagttgtatgaactctttatatactctggatactacactcttgtaacatatattattggcaaattttctgtgcatctgcaggtcatcttttcactttagtgatggtgttctctgaagcgcaaaagtttttaaacttgatgaaatacagtctggctttattcttgcatgtgctttacctaaaatgccaaaacctaattcatggttatgaagatttttgtgtatgatttgttcttagaggtttatagttttagctcttacatttaggcatttgatgcattttaaattaaattttgtatatggtgtaaagtaggaatccaacttaattcttgtatgtggatattcagttattccattgtcttgaaactcttttcaaaatcaattttctataaatgtaagagtttatttttagaccatcagttctatcccattgacctgtatgtctgtcctaatgccagttacacacagtcttgattaccataacttcgtagtaagttttgaactcagacagtctgagtgcttttattttgttctttttcaagattaatttggttattccggatcttttgcatttccatatgaattgtaggttggttgtcaatttctgcaaccagaaggcagcaggattttgacagagagggcattgaatctgtagaccaatgagtatcaatagaattatgtgttatcaaatttagtaaactacgtaaacgataggaacacagctaaaataaaactaagatataagatcgtattaatgtaatgttaataaaagtagattgtctcccattctaattttaatgggcacaaggcatttttgttaatcacttcttattaaataattttttataatattcaggaaaatacaacaacaaaaaacccttacattccaaaggcctcagagtcagagtaatagaaggaaaacgtaaacacatgctgagtaatgcaaacatttggcaacggtggtgactggagctgggagcacagcttttatttctctgacataggagtttgccccttagagttggaccagttttgccttcctctaaatgacaaacagtttggaggtattttaaaggacgttttgtcacttaggatgtttagtaccatgaataatataaatagtcataattccttaattacgatgacaaaatacaagcgaatttagcatcgtgtggtttcctaaggaacatctctctctgagttcacaggttgtcacatgaacatcttccagcatcttgccttctcggatgtggatgttgccagagttctcgccccagatgcttttgtgtgtcgaaccatctgcacctatcatcccagctgcctcttctttacgttctatacgaatgcatggaagatcgagtcacaaaggcgagtatgcatggctagcacttgctgctgtactttcatcaattttattttagagtctgagtttttaaaagtttccttcatttccctcaaaacacttggacctgcagtttaagtaggtacttttctgccaggtgcagattagttaagagattagcagacttctctgcctgtcttctcttactttaaaacacatgttaccagctgggtgcggtggctcccacctgtaatcccagcacattgggaggccgaggcgggtggatcacgaggtcaggagatggagaccatcctggctaacacggtgaaaccccgtctctactaaaaatacacaaaattagccgggcgaggtggcggcgcctgtagtcccagctcctcgggaggctgaggcaggagaatggcgggaacccggggggcggagcttgcagggagccaagatggcgccgctcactccagcctgggtgactgagcgagactccgtctcaaacaaaaaaacaaaaacaaacaaacaaaaaaaaacacgttaccattgaatccaggaagcaatagccatgagaacaaagaaggatctgacgcctttgaatgaagattcaaaacacgatcttcacgttttgtattagcttggagtaaaagccactccctggcagaatatcccttaagcttgttgcctcttccctttgtttcagaaactagagctctgtttattctgatcaaggctctgtcccactctctttatctcagataacccaccctcttctacacacagcatggagctaagagaagggtgcctagttatggaatatcatcagcagcataaactcccagaatttcttctttgatttttttgtttgtttgtttttccagttagaaggtggaacttcgtcactgtcctctcttcaggttgtctgtgcctattagttttctccagagggagatgtggtttgatttacatttaatctctgcaatttattagagtcctgtagtcggatttacttggaagagagtttcccaaaagaataaaatttgccaacttcctttttgggtgtgagctgcttttgtatttgcctaatgcctttaatgcaaacttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaactttacctggtaatgtgattcaataataatattacataaaacgtaacatatttcatgacttaacagcaacagtgttgaaacaatccacaaggtaacagaaacttttgtaaatgtcgttcattgcttttctcatttggtatcttttcatgtttataattgacacagaaccctgccattctaaaatttacccgggagttgactttggaggagaagaattgaatgtgactttcgttaaaggagtgaatgtttgccaagagacttgtacaaagatgattcgctgtcagtttttcacttactctttactcccagaagactgtaaggaggagaagtaagggacattttatttttcatgatcatttcatatcctttttcccctagtgaaggcttactctttctactgttcatttcatctaggtgtaagtgtttcttaagattatcttcggatggttctccaactaggattacatatgggacacaagggagctctggttactctttgagattgtgtaacactggggacagctctggtgagtaacctcactttttcatggaactgtaagggatgtctgtcatgttgatagtgtgcttagtcttaaggaattatatgtcttgttctccttggttagaagggactttgattcacttctaatttcaaccattagcatcaacactcttgtttcagtctgcacaacaaaaacaagctcacgcattgttggaggaacaaactcttcttggggagagtggccctggcaagtgagcctgcaggtgaagctgatggctcagaggcacctgtgtggagggtcactcataggacaccagtgggtcctcactgctgcccactgctttgatgggtaagtgttggatgcatctcatccagagtcttaccttgacttttcattttgaagggtctgtgatcagctgcttcaccgtcatgtgactttatgaatagagacgtgttaaagcagggatggtattcacaacatttaactagcagagtccaagcactgaccagtctgaccatcataacagagtgtggtctctgtacaggactgatggccctgggtgggtattctcccacagaaagagaaacaaacacaatacaccactcctccaacccaccacccgccaccaatcccaccacccatcccaccacacaacccaccacccatcctgacaccaatcccaacaccaattccaccaccaatcccaccaccacccaccaccaatccctccaccaatcccaccaccacccaccaccaatcccatcaccaatcccaccaccaatcccaccaccacccaccaccaatcccaccaccaatcccagcacccgtcccaccaccaatccctccaccaatcccaccaccaatcccaccaccacccaccaccacccaccaccaagcccgccaccaatcccagcacccatcccaccaccaatcccaccatcacccaccaccacccatcaccaatcccaccaccaataacaccaccagtcccaacgctacccaccaccaatcccaccaccaatcccagcacccatcccaccaccaatcccaccaccaatcccaccacccatcccaccaccaatcccaccaccaatcccaccaccaccaatcctaccaccacccaccaccaatcccaccaccaatcccaccaccaatcccaccaccacccaccaccaatcccaccaccagtcccaccaccacccaccaccaatcccaccaccaatcccaccaccacccactaccaatcccaccagcagtcctaccaccaatccctccaccaatcccaccaccacccaccaccaatcccaccaccacccaccactaatcccaccaccaatcccaccagcaatcccaccagcaataaatcaaagacttatttctcaggcccatagaaatgttacttcttgctttttgattaataaatatactaataataatttttaaaagtgagagttttgtactccgtatatttcaacatatgtaatttgatctatttcagttttattggtcaaatagtagacatgttaggtaagtcttaaaacactgaggttttggagttagacaaaacatggcttgagtgataactttgctgcttattagaggtgtggccctaggagatttgtaaatctctctgagctttattttatctaaaagataaataataatagtacctaatttgtaaggttattgggaggattaagtgacacatttaaaatgcttagtactatatgtcgaacatgaacactgctcaacaaatgtaaactatgatttctatattcaataagaagtgtagaaatggacaaagcatatgaaaaagcaaaagaaatactagaagacacttgatttttctaaaaaataaacacaaagtatttttgttttagtgaaattcatgcttagatgctgtgtactaggattgaacatacagccgccaaaatatagcagttggtggtacatgtgggtggagcaagacccctccaccttgtcaccgtgaaggggctccgccatacatgcccttgcatgtggtttaaaggtggttggcctggaagaaaaggcccaagatgggaaacagtaggtgtcttttttactaaatgtactccaatttgagaccaggaattttcattcttgaaggctcagtattgtaagtttataagagataatagacataaaagtacgatgatttcattaaaaaaaggctcctttgcacgtgatatctccgttattttttctagaatattgtgcacacatgccttgcaccacttggtgatgataaagatttctagatctttgcacagaataaggctttgctttagatcataattttggatgtacttagtatgtattcatcttttaaagaatcaatttaaattttcatactttcatatatatatacacacacacatacacaaacacacgcacacactttattttaatattttatttatttatttattgagatggaatctcactctgtcacccaggctggagtgcagtggcaggatctcggctcactgcagcctccgcctcccaggttcaagcgagtctcctgcctcatcctcccaaatttttgtattttcagtagagacggggtttcaccatgttggtcaggctggccttaaactcctggcctcaagtgatccacccgcctcggcctcccgaagtgctgggattacaggtgtgagccactgtgcccggccgtatagagatattttaaacaacactgaagtcctcctactctgcctaattagaagagcattgaaagatcagtctgacttcttgatagttctgaatttaatggagcaatgaggtgcagctttggtgaatgagcttaatttttccatgataaattgctagtctcttcccactacagtgtctctcaaaaatgggacagcaacattctttgtgttttcacttgcagtaagtaagcatgatacaattacataaatgtacacttctcagtttgttaaatagaatcttcagagattcacgtctgccgctattggtgatgaaaaatgacccgtaggaggaattaggtaggagaaaatatgtcctatgtagtatttccttcccagttctctttgaaagagagtgataggaaaaaggaacaatattgaaggaaggccttcccagtttcaaataggttttatttttctctcctaggcttcccttaccggatgtttggcgcatttatagtggcattttaaatctgtcagacattacaaaagaaacacctttctcacaaataaaagagatcattattcaccaaaactatagaatctcagaagggaatcatgatatcgccttaataaaactccaggctcctttgaattacactggtatgtagcgtatgtaagaaggcggatagcagaattgtgctggatgatattttcatatcagtttggacaagagggcagatctagagagactgttgttattttctgaccggtggagttgagggaaaggtgagggttgcatgggaagtgaagatcccacgacttgccatgaaatctcttctacgtaaagagcaagaaacgtgaattagttctttcagggaggagcacagccgcgcgcaggtgatggaaataatggacggaggagatgtctgtgccgtctgagaggcaccgggcttcttttgacaagagtagcagaactgtcattgctttgggcttagggatattagaatgtgtgaggaccagtgggactagatacatatttccaggtataatttgggtaggaaagagactgatgccgaaagaagccctggaaaggccagaacatcgtgatcagaggtgttgcctttggaggttcattgctgccaggagctgaatacccactgtatccaataacattaatggccaggcatggtggctcacccctgtaatccccacactttgggatgcccaggtgggaggattgcttgaggtcaggagtttgagatcagcctgggcaacacagtgagaccctgtctctacataaaattacaaaaaaaacaattaactgggtgtggtggtgtgcacctgtagtccaagctagtcaggaggctgagacaagaggatcatgtcagcccaggaggtcaaggctgtagtgagccaagatagtgccactgcacacaattatgtgaccttgggcaagttgctttacctctttgcacctcttaatttcctcatctgtaaaatgaggatgataatttcttcctgggtttgttgtaataatcaatacattaaagcacttcatgtctggaacagtgaagacacctgctatgactattaaggatagcatacacggaataagacgcaggaacttctaaatgcttttgaccgtagatttaggttctgagttttaagaatgtaactcaggaaattgtaacaccaaaaaggtcatgtgaaaaatggtggtgacaaattttcttgaatcaatagccttagaagttgggcagaaagcaaaaaagttattcttggtgctactctatagaaagagaagacagaaaaagaaaaagatgtatttttaaagtctatatccataactttatttgaccaaactctaatttaaaaattatgtttcagaattccaaaaaccaatatgcctaccttccaaaggtgacacaaacacaatttataccaactgttgggtaactggatggggcttctcgaaggaaaaaggtacagcatgatgctttaaatattgcttctagagtaagtcttacatgttgagatgcatggagtgggtcgttttaatcggcttctctctgaaattatatcgaacccctttatctttcctacctatttattccccaatatttattcagttattcttaaaaaacgtatttttgctttggcttgaaaaaaaaattttagggagaattttaagcatcttacttcattctaaagatcgtttgcttgacttcgcatgaaagattgtccccatctaaggctgacgagcccgtgcaagaccatctggtcctcagtgttagcagcattcccatctcccaataccatgttctcccttgatgctaatggccgggagcacaggcaggcgtgtcgcctctctctgtggccagttcttcatcttcttcttccaggcacccttcctgcaatctgaggaagcctaggaaccacttctctaacaatgcttttaaatgcttaaataaaatacacaggattacaaaagaaaccaagtgaagtgcaagacagttctcaaaatactttcaaaaagtactacaataatatatatgcctctttattaatcctctacatagcgagttattctaataccaaacctacttttgaaatagtggtgagcataaatggcattttcacttatctgccacaacagaaaagggatatgaaaatatctgtaatctctgttgatggcaaagtcataggtgccactgatactgctgtgtttgttgtctgcattcgtaatcgaagggagtggtaggcttcatctggaggtttgtgaaaacaaagactttttttctacacaaatttataagccatgtgaattctttctgaggaccttaggtttgcaattcctacttgtgggtatctggagtgttccaatcgtccttgaactttttaaaaaacagaccagtctccctttccaaaattatgttcctgatagacactatggagaataatatctgtgtcattctttacagaagaaggtagcttgccaaactctctccatctttcccgattcagtccttagttcaagtgattcacatttttagattttttactggtaatctgagacaagaagaaattaaaagtaatcttcactaagcaacgaaagctcccaacactgtcctccccatgagagatgctcgcttgcatttactcagaaacaaaagaccccaagacccctctgtcgcgaaagctcggagggcttttcagaaacgatagggctttcaattataatttggaatatatgaaacaaaaaaatgaaaagtgagaacttccaggctttggatttttgtagatgataaatataaaatgggatttctgggggactgttaccgagatgaggggatggaagaagacacggaagcaaggtctctggtcagcccagggtgctgggcttgtcccaacaccacacaggtaataagaggacagtgcagggctccgtgtctctctctctctctctctctctgtgtgtgtgtgtgtgtgtaacactaccttcctaatttttactatttgtattcaaagatacggcccttataaaaaagtacactgctctgattcacttgaaaacttatttccatatttactatttattgtgtttcctccctctgaagttatatattggttacttcacaggtgaaatccaagatattctacaaaaggtaaatattcctttggtaacaaatgaagaatgccagaaaagatatcaagattataaaataacccaacggatggtctgtgctggctataaagaagggggaaaagatgcttgtaaggtaatgcatgagattatgaaaaacacaataggctgcttgagaaaattcacttcaaaatatattttccaatagcataatttattatagtttttaaaaaaaattcagagacaaatgatctgataaatttataagcaacttttaacaaattgaatatatacaatacatatttatattattcatgatgtatgtcacaatctatgcatgtgctaatttaagagggacaaaaatacatacaataattgcactaaaatataaaaacattagatttctttgtcattgggatgatgatatcaagatttctttgttagatttatttaagaattgaagaggggatacaaaaaatgcaggcacatgagatacttggagaactttaagaaagtttgtgtgtgtgtgtgtgtgtatgtgtatgtgtgtgttgctgtgtagtggactacagaattttagaggtggtcacttatttgagtcccattgtcataactttctaccattttatttttcccctgtgactcagggagattcagggggtcccttagcttgcaaacacaatggaatgtggcgtttggtgggcatcaccagctggggcgaaggctgtgcccgcagggagcaacctggtgtctacaccaaagtcgctgagtacatggactggattttagagaaaacacagagcagtgatggaaacgctcggatgcaggcgccagcatgaggagcagcccagagtcttggcgagttttacaacctgggttcaagtcaaattctgagcctgggggtcctcatctgcaaagcatggagagtggcatctactttgcatcctgtcataaggacaaaagacagtgcactcagagctgctgaggacaatgttttgctgaagccagctttcagcattcagtaactgggagctgataatgtgaagtcgcaaccgagatctccatgattgtgtgtcgtaaaataaaatggtaaaagatcacaattagcaagtgttttcttctggttgtgaaacagaactgaaagtaagtggttgaggttctagcacagtgcctggactccctctaattgcactacttcttctggaactcagtctatctcaaagatgtaatttcctctccttgctgcacctggttagccactgaaacccacgattgtctgcttcacttgtggcaaagagctagcaggcttgggttctgttctgccgagtggaagggagaacacctgcgtcacacccactcttataagaaagagatgggttacctgaacccatagggtatatttgcctcttggcctcctaactttgctactggggcatggataggagggtccaggctgcgtgtgtggaggaactcgaggggctgcagcattgcacagccttcatggtaggcaaggaatctgctttgcaaggggcattagccctggaggctcagtggatatgggctattgcaatactaattcaaggagcatttttaggatggcacattggctcatgcctgtaattccaacaatttgggagatcacggcaggtggatctcttgagcctaggagttcaagaccagcctgggcaatgtgacaaaaccccatctctacaaaaattagctgggcgtggtggtgcatacctgtaatcccagctcccccagaagctgaggcaggaggatcacttgagtgtggctgcagtgagcagagatcgcactactgcattccagcctggacgacagagtgagactctgtctcaaaaaaaaaaggaagcattgttaggtataaattactattatttatttatttatttttgaaaggagtctcgctctgtcacccaggctgcagtgcagtggcgccatctcggctcactgcaagctccgcctcccaggttcacagcattctcctgcctcagcctcccgagtagctgggattataggtgcccgccaccacgcctggctaattttttgtatttttagtagaaacggggtttcactgtgttggccaggatggtctcgatctcctgactttgtgatccacctgccttggcctcccaaagtgctgggattacagacttgaaccaccatgcccggccctgttaggtataaactatttcataaaattcagacttgtaaatttatcatagcctttagaatggatgatagaaatccttatgccacacaaattcctcatatgccagggctcaccataactgataccagctcacttgattcagctcagtttaacatttacacagaattggccatttacaaaatcttacataagttaagtagaaaaatagaaaagtgaggttttctgaaagagtttgggtttttccttcaatgctcaacaacagaggtccccaatctttctggcaccagagaccagttttgtgcaagacactttttccatgaaccagcgtggtgggggggggatgattctggaatgattcaagtgcatgacatttattgtg

SEQ ID NO: 19 - skipped

SEQ ID NO: 20 - DNA, 23 bp, Artificial sequence
  Primer
ccaaaaaaggtgcaccagtaaca

SEQ ID NO: 21 - DNA, 24 bp, Artificial sequence
  Primer
cctccgggactgtactttaatagg

SEQ ID NO: 22 - DNA, 29 bp, Artificial sequence
  Probe
cacgcaaacatttcacaaggcagagtacc

SEQ ID NO: 23 - DNA, 20 bp, Artificial sequence
  Primer
cctgtgtggagggtcactca

SEQ ID NO: 24 - DNA, 23 bp, Artificial sequence
  Primer
ccactatagatgcgccaaacatc

SEQ ID NO: 25 - DNA, 23 bp, Artificial sequence
  Probe
cccactgctttgatgggcttccc

SEQ ID NO: 26-29 - skipped (4 entries)

SEQ ID NO: 30 - DNA, 20 bp, Artificial sequence
  Synthetic Oligonucleotide
aacggtcttcaagctgttct

SEQ ID NO: 31 - DNA, 20 bp, Artificial sequence
  Synthetic Oligonucleotide
aaatgaacggtcttcaagct

SEQ ID NO: 32 - DNA, 20 bp, Artificial sequence
  Synthetic Oligonucleotide
cttaaaaatgaacggtcttc

SEQ ID NO: 33 - DNA, 20 bp, Artificial sequence
  Synthetic Oligonucleotide
tgtcacttaaaaatgaacgg

SEQ ID NO: 34 - DNA, 20 bp, Artificial sequence
  Synthetic Oligonucleotide
tggaggtgagtctcttgtca

SEQ ID NO: 35 - DNA, 20 bp, Artificial sequence
  Synthetic Oligonucleotide
cttcttggaggtgagtctct

SEQ ID NO: 36 - DNA, 20 bp, Artificial sequence
  Synthetic Oligonucleotide
gcttgaataaaatcattctg

SEQ ID NO: 37 - DNA, 20 bp, Artificial sequence
  Synthetic Oligonucleotide
tgcttgcttgaataaaatca

SEQ ID NO: 38 - DNA, 20 bp, Artificial sequence
  Synthetic Oligonucleotide
taagttgcttgcttgaataa

SEQ ID NO: 39 - DNA, 20 bp, Artificial sequence
  Synthetic Oligonucleotide
ggaaatgaaataagttgctt

SEQ ID NO: 40 - DNA, 20 bp, Artificial sequence
  Synthetic Oligonucleotide
aacaaggaaatgaaataagt

SEQ ID NO: 41 - DNA, 20 bp, Artificial sequence
  Synthetic Oligonucleotide
tagcaaacaaggaaatgaaa

SEQ ID NO: 42 - DNA, 20 bp, Artificial sequence
  Synthetic Oligonucleotide
aactgtagcaaacaaggaaa

SEQ ID NO: 43 - DNA, 20 bp, Artificial sequence
  Synthetic Oligonucleotide
caggaaactgtagcaaacaa

SEQ ID NO: 44 - DNA, 20 bp, Artificial sequence
  Synthetic Oligonucleotide
atccacaggaaactgtagca

SEQ ID NO: 45 - DNA, 20 bp, Artificial sequence
  Synthetic Oligonucleotide
cagacatccacaggaaactg

SEQ ID NO: 46 - DNA, 20 bp, Artificial sequence
  Synthetic Oligonucleotide
atccccacctctgaagaagg

SEQ ID NO: 47 - DNA, 20 bp, Artificial sequence
  Synthetic Oligonucleotide
tacatccccacctctgaaga

SEQ ID NO: 48 - DNA, 20 bp, Artificial sequence
  Synthetic Oligonucleotide
gaagctacatccccacctct

SEQ ID NO: 49 - DNA, 20 bp, Artificial sequence
  Synthetic Oligonucleotide
acatggaagctacatcccca

SEQ ID NO: 50 - DNA, 20 bp, Artificial sequence
  Synthetic Oligonucleotide
ggtgtacatggaagctacat

SEQ ID NO: 51 - DNA, 20 bp, Artificial sequence
  Synthetic Oligonucleotide
accttgggtggaatgtgcac

SEQ ID NO: 52 - DNA, 20 bp, Artificial sequence
  Synthetic Oligonucleotide
caaacaccttgggtggaatg

SEQ ID NO: 53 - DNA, 20 bp, Artificial sequence
  Synthetic Oligonucleotide
ctgaatagcaaacaccttgg

SEQ ID NO: 54 - DNA, 20 bp, Artificial sequence
  Synthetic Oligonucleotide
gaaaactgaatagcaaacac

SEQ ID NO: 55 - DNA, 20 bp, Artificial sequence
  Synthetic Oligonucleotide
tggaagaaaactgaatagca

SEQ ID NO: 56 - DNA, 20 bp, Artificial sequence
  Synthetic Oligonucleotide
caaaccttttctccatgtca

SEQ ID NO: 57 - DNA, 20 bp, Artificial sequence
  Synthetic Oligonucleotide
acactatctttcaagaagca

SEQ ID NO: 58 - DNA, 20 bp, Artificial sequence
  Synthetic Oligonucleotide
ggcaagcacttatttgatga

SEQ ID NO: 59 - DNA, 20 bp, Artificial sequence
  Synthetic Oligonucleotide
ttaaaattgactcctctcat

SEQ ID NO: 60 - DNA, 20 bp, Artificial sequence
  Synthetic Oligonucleotide
tcaacactgctaaccttaga

SEQ ID NO: 61 - DNA, 20 bp, Artificial sequence
  Synthetic Oligonucleotide
attcttcaacactgctaacc

SEQ ID NO: 62 - DNA, 20 bp, Artificial sequence
  Synthetic Oligonucleotide
ttggcattcttcaacactgc

SEQ ID NO: 63 - DNA, 20 bp, Artificial sequence
  Synthetic Oligonucleotide
ccttttttggcattcttcaa

SEQ ID NO: 64 - DNA, 20 bp, Artificial sequence
  Synthetic Oligonucleotide
tggtgcaccttttttggcat

SEQ ID NO: 65 - DNA, 20 bp, Artificial sequence
  Synthetic Oligonucleotide
cttcagtgagaatccagatt

SEQ ID NO: 66 - DNA, 20 bp, Artificial sequence
  Synthetic Oligonucleotide
ggcacagggcttcagtgaga

SEQ ID NO: 67 - DNA, 20 bp, Artificial sequence
  Synthetic Oligonucleotide
aatttctgaaagggcacagg

SEQ ID NO: 68 - DNA, 20 bp, Artificial sequence
  Synthetic Oligonucleotide
caaccaatttctgaaagggc

SEQ ID NO: 69 - DNA, 20 bp, Artificial sequence
  Synthetic Oligonucleotide
caagatgctggaagatgttc

SEQ ID NO: 70 - DNA, 20 bp, Artificial sequence
  Synthetic Oligonucleotide
gtgccactttcagatgtttt

SEQ ID NO: 71 - DNA, 20 bp, Artificial sequence
  Synthetic Oligonucleotide
ttggtgtgccactttcagat

SEQ ID NO: 72 - DNA, 20 bp, Artificial sequence
  Synthetic Oligonucleotide
ggaacttggtgtgccacttt

SEQ ID NO: 73 - DNA, 20 bp, Artificial sequence
  Synthetic Oligonucleotide
gtagaggaacttggtgtgcc

SEQ ID NO: 74 - DNA, 20 bp, Artificial sequence
  Synthetic Oligonucleotide
gaggagtagaggaacttggt

SEQ ID NO: 75 - DNA, 20 bp, Artificial sequence
  Synthetic Oligonucleotide
ttcttgaggagtagaggaac

SEQ ID NO: 76 - DNA, 20 bp, Artificial sequence
  Synthetic Oligonucleotide
gtgttttcttgaggagtaga

SEQ ID NO: 77 - DNA, 20 bp, Artificial sequence
  Synthetic Oligonucleotide
atatggtgttttcttgagga

SEQ ID NO: 78 - DNA, 20 bp, Artificial sequence
  Synthetic Oligonucleotide
tccagatatggtgttttctt

SEQ ID NO: 79 - DNA, 20 bp, Artificial sequence
  Synthetic Oligonucleotide
ctatatccagatatggtgtt

SEQ ID NO: 80 - DNA, 20 bp, Artificial sequence
  Synthetic Oligonucleotide
ggttaaaaggctatatccag

SEQ ID NO: 81 - DNA, 20 bp, Artificial sequence
  Synthetic Oligonucleotide
ttgcaggttaaaaggctata

SEQ ID NO: 82 - DNA, 20 bp, Artificial sequence
  Synthetic Oligonucleotide
ttcttttgcaggttaaaagg

SEQ ID NO: 83 - DNA, 20 bp, Artificial sequence
  Synthetic Oligonucleotide
taaagttcttttgcaggtta

SEQ ID NO: 84 - DNA, 20 bp, Artificial sequence
  Synthetic Oligonucleotide
atggcagggttcaggtaaag

SEQ ID NO: 85 - DNA, 20 bp, Artificial sequence
  Synthetic Oligonucleotide
ttagaatggcagggttcagg

SEQ ID NO: 86 - DNA, 20 bp, Artificial sequence
  Synthetic Oligonucleotide
aaattttagaatggcagggt

SEQ ID NO: 87 - DNA, 20 bp, Artificial sequence
  Synthetic Oligonucleotide
cgggtaaattttagaatggc

SEQ ID NO: 88 - DNA, 20 bp, Artificial sequence
  Synthetic Oligonucleotide
actcccgggtaaattttaga

SEQ ID NO: 89 - DNA, 20 bp, Artificial sequence
  Synthetic Oligonucleotide
tccaaagtcaactcccgggt

SEQ ID NO: 90 - DNA, 20 bp, Artificial sequence
  Synthetic Oligonucleotide
tctcctccaaagtcaactcc

SEQ ID NO: 91 - DNA, 20 bp, Artificial sequence
  Synthetic Oligonucleotide
attcttctcctccaaagtca

SEQ ID NO: 92 - DNA, 20 bp, Artificial sequence
  Synthetic Oligonucleotide
attcaattcttctcctccaa

SEQ ID NO: 93 - DNA, 20 bp, Artificial sequence
  Synthetic Oligonucleotide
gtcacattcaattcttctcc

SEQ ID NO: 94 - DNA, 20 bp, Artificial sequence
  Synthetic Oligonucleotide
caaacattcactcctttaac

SEQ ID NO: 95 - DNA, 20 bp, Artificial sequence
  Synthetic Oligonucleotide
cttggcaaacattcactcct

SEQ ID NO: 96 - DNA, 20 bp, Artificial sequence
  Synthetic Oligonucleotide
agtctcttggcaaacattca

SEQ ID NO: 97 - DNA, 20 bp, Artificial sequence
  Synthetic Oligonucleotide
tgacagcgaatcatctttgt

SEQ ID NO: 98 - DNA, 20 bp, Artificial sequence
  Synthetic Oligonucleotide
aaaactgacagcgaatcatc

SEQ ID NO: 99 - DNA, 20 bp, Artificial sequence
  Synthetic Oligonucleotide
agtgaaaaactgacagcgaa

SEQ ID NO: 100 - DNA, 20 bp, Artificial sequence
  Synthetic Oligonucleotide
cagtcttctgggagtaaaga

SEQ ID NO: 101 - DNA, 20 bp, Artificial sequence
  Synthetic Oligonucleotide
aagaaacacttacacttctc

SEQ ID NO: 102 - DNA, 20 bp, Artificial sequence
  Synthetic Oligonucleotide
agataatcttaagaaacact

SEQ ID NO: 103 - DNA, 20 bp, Artificial sequence
  Synthetic Oligonucleotide
gagctcccttgtgtcccata

SEQ ID NO: 104 - DNA, 20 bp, Artificial sequence
  Synthetic Oligonucleotide
aaccagagctcccttgtgtc

SEQ ID NO: 105 - DNA, 20 bp, Artificial sequence
  Synthetic Oligonucleotide
agagtaaccagagctccctt

SEQ ID NO: 106 - DNA, 20 bp, Artificial sequence
  Synthetic Oligonucleotide
ctcaaagagtaaccagagct

SEQ ID NO: 107 - DNA, 20 bp, Artificial sequence
  Synthetic Oligonucleotide
gcttgtttttgttgtgcaga

SEQ ID NO: 108 - DNA, 20 bp, Artificial sequence
  Synthetic Oligonucleotide
acccaacagttggtataaat

SEQ ID NO: 109 - DNA, 20 bp, Artificial sequence
  Synthetic Oligonucleotide
aggcatattggtttttggaa

SEQ ID NO: 110 - DNA, 20 bp, Artificial sequence
  Synthetic Oligonucleotide
aacacaattgcttcttggag

SEQ ID NO: 111 - DNA, 20 bp, Artificial sequence
  Synthetic Oligonucleotide
tgctggaagatgttcatgtg

SEQ ID NO: 112 - DNA, 20 bp, Artificial sequence
  Synthetic Oligonucleotide
tttgttcctccaacaatgcg

SEQ ID NO: 113 - DNA, 20 bp, Artificial sequence
  Synthetic Oligonucleotide
aagagtttgttcctccaaca

SEQ ID NO: 114 - DNA, 20 bp, Artificial sequence
  Synthetic Oligonucleotide
ccaagaagagtttgttcctc

SEQ ID NO: 115 - DNA, 20 bp, Artificial sequence
  Synthetic Oligonucleotide
tctccccaagaagagtttgt

SEQ ID NO: 116 - DNA, 20 bp, Artificial sequence
  Synthetic Oligonucleotide
ccagggccactctccccaag

SEQ ID NO: 117 - DNA, 20 bp, Artificial sequence
  Synthetic Oligonucleotide
agcttcacctgcaggctcac

SEQ ID NO: 118 - DNA, 20 bp, Artificial sequence
  Synthetic Oligonucleotide
tatgagtgaccctccacaca

SEQ ID NO: 119 - DNA, 20 bp, Artificial sequence
  Synthetic Oligonucleotide
tgtcctatgagtgaccctcc

SEQ ID NO: 120 - DNA, 20 bp, Artificial sequence
  Synthetic Oligonucleotide
actggtgtcctatgagtgac

SEQ ID NO: 121 - DNA, 20 bp, Artificial sequence
  Synthetic Oligonucleotide
gacccactggtgtcctatga

SEQ ID NO: 122 - DNA, 20 bp, Artificial sequence
  Synthetic Oligonucleotide
gtgaggacccactggtgtcc

SEQ ID NO: 123 - DNA, 20 bp, Artificial sequence
  Synthetic Oligonucleotide
aagcccatcaaagcagtggg

SEQ ID NO: 124 - DNA, 20 bp, Artificial sequence
  Synthetic Oligonucleotide
gtctgacagatttaaaatgc

SEQ ID NO: 125 - DNA, 20 bp, Artificial sequence
  Synthetic Oligonucleotide
gtaatgtctgacagatttaa

SEQ ID NO: 126 - DNA, 20 bp, Artificial sequence
  Synthetic Oligonucleotide
cttttgtaatgtctgacaga

SEQ ID NO: 127 - DNA, 20 bp, Artificial sequence
  Synthetic Oligonucleotide
tttatttgtgagaaaggtgt

SEQ ID NO: 128 - DNA, 20 bp, Artificial sequence
  Synthetic Oligonucleotide
tctcttttatttgtgagaaa

SEQ ID NO: 129 - DNA, 20 bp, Artificial sequence
  Synthetic Oligonucleotide
atcatgattcccttctgaga

SEQ ID NO: 130 - DNA, 20 bp, Artificial sequence
  Synthetic Oligonucleotide
aaaggagcctggagttttat

SEQ ID NO: 131 - DNA, 20 bp, Artificial sequence
  Synthetic Oligonucleotide
aattcaaaggagcctggagt

SEQ ID NO: 132 - DNA, 20 bp, Artificial sequence
  Synthetic Oligonucleotide
agtgtaattcaaaggagcct

SEQ ID NO: 133 - DNA, 20 bp, Artificial sequence
  Synthetic Oligonucleotide
aattcagtgtaattcaaagg

SEQ ID NO: 134 - DNA, 20 bp, Artificial sequence
  Synthetic Oligonucleotide
tttggaattcagtgtaattc

SEQ ID NO: 135 - DNA, 20 bp, Artificial sequence
  Synthetic Oligonucleotide
tggtttttggaattcagtgt

SEQ ID NO: 136 - DNA, 20 bp, Artificial sequence
  Synthetic Oligonucleotide
attggtttttggaattcagt

SEQ ID NO: 137 - DNA, 20 bp, Artificial sequence
  Synthetic Oligonucleotide
catattggtttttggaattc

SEQ ID NO: 138 - DNA, 20 bp, Artificial sequence
  Synthetic Oligonucleotide
gtaggcatattggtttttgg

SEQ ID NO: 139 - DNA, 20 bp, Artificial sequence
  Synthetic Oligonucleotide
gtgtcacctttggaaggtag

SEQ ID NO: 140 - DNA, 20 bp, Artificial sequence
  Synthetic Oligonucleotide
aacagttggtataaattgtg

SEQ ID NO: 141 - DNA, 20 bp, Artificial sequence
  Synthetic Oligonucleotide
caacagttggtataaattgt

SEQ ID NO: 142 - DNA, 20 bp, Artificial sequence
  Synthetic Oligonucleotide
tacccaacagttggtataaa

SEQ ID NO: 143 - DNA, 20 bp, Artificial sequence
  Synthetic Oligonucleotide
tccttcgagaagccccatcc

SEQ ID NO: 144 - DNA, 20 bp, Artificial sequence
  Synthetic Oligonucleotide
aaaggaatatttaccttttg

SEQ ID NO: 145 - DNA, 20 bp, Artificial sequence
  Synthetic Oligonucleotide
ttaccaaaggaatatttacc

SEQ ID NO: 146 - DNA, 20 bp, Artificial sequence
  Synthetic Oligonucleotide
atttgttaccaaaggaatat

SEQ ID NO: 147 - DNA, 20 bp, Artificial sequence
  Synthetic Oligonucleotide
ggcattcttcatttgttacc

SEQ ID NO: 148 - DNA, 20 bp, Artificial sequence
  Synthetic Oligonucleotide
tttctggcattcttcatttg

SEQ ID NO: 149 - DNA, 20 bp, Artificial sequence
  Synthetic Oligonucleotide
gatatcttttctggcattct

SEQ ID NO: 150 - DNA, 20 bp, Artificial sequence
  Synthetic Oligonucleotide
atcttgatatcttttctggc

SEQ ID NO: 151 - DNA, 20 bp, Artificial sequence
  Synthetic Oligonucleotide
ttataatcttgatatctttt

SEQ ID NO: 152 - DNA, 20 bp, Artificial sequence
  Synthetic Oligonucleotide
ttattttataatcttgatat

SEQ ID NO: 153 - DNA, 20 bp, Artificial sequence
  Synthetic Oligonucleotide
ttgggttattttataatctt

SEQ ID NO: 154 - DNA, 20 bp, Artificial sequence
  Synthetic Oligonucleotide
atccgttgggttattttata

SEQ ID NO: 155 - DNA, 20 bp, Artificial sequence
  Synthetic Oligonucleotide
agaccatccgttgggttatt

SEQ ID NO: 156 - DNA, 20 bp, Artificial sequence
  Synthetic Oligonucleotide
agcacagaccatccgttggg

SEQ ID NO: 157 - DNA, 20 bp, Artificial sequence
  Synthetic Oligonucleotide
ctttatagccagcacagacc

SEQ ID NO: 158 - DNA, 20 bp, Artificial sequence
  Synthetic Oligonucleotide
cccttctttatagccagcac

SEQ ID NO: 159 - DNA, 20 bp, Artificial sequence
  Synthetic Oligonucleotide
tttcccccttctttatagcc

SEQ ID NO: 160 - DNA, 20 bp, Artificial sequence
  Synthetic Oligonucleotide
catcttttcccccttcttta

SEQ ID NO: 161 - DNA, 20 bp, Artificial sequence
  Synthetic Oligonucleotide
cccttacaagcatcttttcc

SEQ ID NO: 162 - DNA, 20 bp, Artificial sequence
  Synthetic Oligonucleotide
acattccattgtgtttgcaa

SEQ ID NO: 163 - DNA, 20 bp, Artificial sequence
  Synthetic Oligonucleotide
tggtgatgcccaccaaacgc

SEQ ID NO: 164 - DNA, 20 bp, Artificial sequence
  Synthetic Oligonucleotide
tgctccctgcgggcacagcc

SEQ ID NO: 165 - DNA, 20 bp, Artificial sequence
  Synthetic Oligonucleotide
caggttgctccctgcgggca

SEQ ID NO: 166 - DNA, 20 bp, Artificial sequence
  Synthetic Oligonucleotide
gacaccaggttgctccctgc

SEQ ID NO: 167 - DNA, 20 bp, Artificial sequence
  Synthetic Oligonucleotide
gtgtagacaccaggttgctc

SEQ ID NO: 168 - DNA, 20 bp, Artificial sequence
  Synthetic Oligonucleotide
ctttggtgtagacaccaggt

SEQ ID NO: 169 - DNA, 20 bp, Artificial sequence
  Synthetic Oligonucleotide
agcgactttggtgtagacac

SEQ ID NO: 170 - DNA, 20 bp, Artificial sequence
  Synthetic Oligonucleotide
tactcagcgactttggtgta

SEQ ID NO: 171 - DNA, 20 bp, Artificial sequence
  Synthetic Oligonucleotide
ccatgtactcagcgactttg

SEQ ID NO: 172 - DNA, 20 bp, Artificial sequence
  Synthetic Oligonucleotide
ccagtccatgtactcagcga

SEQ ID NO: 173 - DNA, 20 bp, Artificial sequence
  Synthetic Oligonucleotide
ctgtgttttctctaaaatcc

SEQ ID NO: 174 - DNA, 20 bp, Artificial sequence
  Synthetic Oligonucleotide
ctgctctgtgttttctctaa

SEQ ID NO: 175 - DNA, 20 bp, Artificial sequence
  Synthetic Oligonucleotide
gctcagaatttgacttgaac

SEQ ID NO: 176 - DNA, 20 bp, Artificial sequence
  Synthetic Oligonucleotide
cccaggctcagaatttgact

SEQ ID NO: 177 - DNA, 20 bp, Artificial sequence
  Synthetic Oligonucleotide
ctttgcagatgaggaccccc

SEQ ID NO: 178 - DNA, 20 bp, Artificial sequence
  Synthetic Oligonucleotide
ccatgctttgcagatgagga

SEQ ID NO: 179 - DNA, 20 bp, Artificial sequence
  Synthetic Oligonucleotide
actctccatgctttgcagat

SEQ ID NO: 180 - DNA, 20 bp, Artificial sequence
  Synthetic Oligonucleotide
atgccactctccatgctttg

SEQ ID NO: 181 - DNA, 20 bp, Artificial sequence
  Synthetic Oligonucleotide
agcagctctgagtgcactgt

SEQ ID NO: 182 - DNA, 20 bp, Artificial sequence
  Synthetic Oligonucleotide
tcctcagcagctctgagtgc

SEQ ID NO: 183 - DNA, 20 bp, Artificial sequence
  Synthetic Oligonucleotide
cattgtcctcagcagctctg

SEQ ID NO: 184 - DNA, 20 bp, Artificial sequence
  Synthetic Oligonucleotide
tggtttttggaattctgaaa

SEQ ID NO: 185 - DNA, 20 bp, Artificial sequence
  Synthetic Oligonucleotide
atattggtttttggaattct

SEQ ID NO: 186 - DNA, 20 bp, Artificial sequence
  Synthetic Oligonucleotide
tgtactagtttcctataact

SEQ ID NO: 187 - DNA, 20 bp, Artificial sequence
  Synthetic Oligonucleotide
atagggacacaaccaaggaa

SEQ ID NO: 188 - DNA, 20 bp, Artificial sequence
  Synthetic Oligonucleotide
aggcacagagccagcaccca

SEQ ID NO: 189 - DNA, 20 bp, Artificial sequence
  Synthetic Oligonucleotide
cctgcctcctggcagccttc

SEQ ID NO: 190 - DNA, 20 bp, Artificial sequence
  Synthetic Oligonucleotide
ccaggtgtggacagcagctg

SEQ ID NO: 191 - DNA, 20 bp, Artificial sequence
  Synthetic Oligonucleotide
ggttttgtttgtaaaattag

SEQ ID NO: 192 - DNA, 20 bp, Artificial sequence
  Synthetic Oligonucleotide
aaaacaccattaaatccatt

SEQ ID NO: 193 - DNA, 20 bp, Artificial sequence
  Synthetic Oligonucleotide
acagaaaccatgatgttgct

SEQ ID NO: 194 - DNA, 20 bp, Artificial sequence
  Synthetic Oligonucleotide
tcagcccaatgtcctaacct

SEQ ID NO: 195 - DNA, 20 bp, Artificial sequence
  Synthetic Oligonucleotide
ccttcactgactctcttttc

SEQ ID NO: 196 - DNA, 20 bp, Artificial sequence
  Synthetic Oligonucleotide
ttctcctggctcagaagctc

SEQ ID NO: 197 - DNA, 20 bp, Artificial sequence
  Synthetic Oligonucleotide
gaatgtcaggcctctgggcc

SEQ ID NO: 198 - DNA, 20 bp, Artificial sequence
  Synthetic Oligonucleotide
ctaacaaccccacaatatca

SEQ ID NO: 199 - DNA, 20 bp, Artificial sequence
  Synthetic Oligonucleotide
cccaattcttagtcctttaa

SEQ ID NO: 200 - DNA, 20 bp, Artificial sequence
  Synthetic Oligonucleotide
accaagctcagcctccaact

SEQ ID NO: 201 - DNA, 20 bp, Artificial sequence
  Synthetic Oligonucleotide
ttattagtcaaatcacccaa

SEQ ID NO: 202 - DNA, 20 bp, Artificial sequence
  Synthetic Oligonucleotide
tggatgggtagaggcctttc

SEQ ID NO: 203 - DNA, 20 bp, Artificial sequence
  Synthetic Oligonucleotide
ccccctcccttccctacaca

SEQ ID NO: 204 - DNA, 20 bp, Artificial sequence
  Synthetic Oligonucleotide
atgtaagttacaagccacta

SEQ ID NO: 205 - DNA, 20 bp, Artificial sequence
  Synthetic Oligonucleotide
tgcctctttaataaaaactc

SEQ ID NO: 206 - DNA, 20 bp, Artificial sequence
  Synthetic Oligonucleotide
actcattgccttaactcagg

SEQ ID NO: 207 - DNA, 20 bp, Artificial sequence
  Synthetic Oligonucleotide
acttgaccttactgttttag

SEQ ID NO: 208 - DNA, 20 bp, Artificial sequence
  Synthetic Oligonucleotide
ctcctccccaggctgctcct

SEQ ID NO: 209 - DNA, 20 bp, Artificial sequence
  Synthetic Oligonucleotide
aagatctagataattcttgt

SEQ ID NO: 210 - DNA, 20 bp, Artificial sequence
  Synthetic Oligonucleotide
tcaactcacacctgacctaa

SEQ ID NO: 211 - DNA, 20 bp, Artificial sequence
  Synthetic Oligonucleotide
tgaacccaaaactctggcac

SEQ ID NO: 212 - DNA, 20 bp, Artificial sequence
  Synthetic Oligonucleotide
agcccaaggaacatctcacc

SEQ ID NO: 213 - DNA, 20 bp, Artificial sequence
  Synthetic Oligonucleotide
gcctgtttggtggtctcttc

SEQ ID NO: 214 - DNA, 20 bp, Artificial sequence
  Synthetic Oligonucleotide
cttctcctggctcagaagct

SEQ ID NO: 215 - DNA, 20 bp, Artificial sequence
  Synthetic Oligonucleotide
atgtatgattctaagaactt

SEQ ID NO: 216 - DNA, 20 bp, Artificial sequence
  Synthetic Oligonucleotide
aacagacacattatttatat

SEQ ID NO: 217 - DNA, 20 bp, Artificial sequence
  Synthetic Oligonucleotide
agagtcaagtccacagacat

SEQ ID NO: 218 - DNA, 20 bp, Artificial sequence
  Synthetic Oligonucleotide
tcctaaataggaacaaagta

SEQ ID NO: 219 - DNA, 20 bp, Artificial sequence
  Synthetic Oligonucleotide
ttgttaaggttgtagagaga

SEQ ID NO: 220 - DNA, 20 bp, Artificial sequence
  Synthetic Oligonucleotide
acccaattatttttaatggc

SEQ ID NO: 221 - DNA, 20 bp, Artificial sequence
  Synthetic Oligonucleotide
gcctaaatgtaagagctaaa

SEQ ID NO: 222 - DNA, 20 bp, Artificial sequence
  Synthetic Oligonucleotide
taaactcttacatttataga

SEQ ID NO: 223 - DNA, 20 bp, Artificial sequence
  Synthetic Oligonucleotide
aaataaaagcactcagactg

SEQ ID NO: 224 - DNA, 20 bp, Artificial sequence
  Synthetic Oligonucleotide
ttggtctacagattcaatgc

SEQ ID NO: 225 - DNA, 20 bp, Artificial sequence
  Synthetic Oligonucleotide
taacaaaaatgccttgtgcc

SEQ ID NO: 226 - DNA, 20 bp, Artificial sequence
  Synthetic Oligonucleotide
tcccagctccagtcaccacc

SEQ ID NO: 227 - DNA, 20 bp, Artificial sequence
  Synthetic Oligonucleotide
gtactaaacatcctaagtga

SEQ ID NO: 228 - DNA, 20 bp, Artificial sequence
  Synthetic Oligonucleotide
actcgcctttgtgactcgat

SEQ ID NO: 229 - DNA, 20 bp, Artificial sequence
  Synthetic Oligonucleotide
ttttgaatcttcattcaaag

SEQ ID NO: 230 - DNA, 20 bp, Artificial sequence
  Synthetic Oligonucleotide
cagagccttgatcagaataa

SEQ ID NO: 231 - DNA, 20 bp, Artificial sequence
  Synthetic Oligonucleotide
aagttccaccttctaactgg

SEQ ID NO: 232 - DNA, 20 bp, Artificial sequence
  Synthetic Oligonucleotide
agcagctcacacccaaaaag

SEQ ID NO: 233 - DNA, 20 bp, Artificial sequence
  Synthetic Oligonucleotide
ttctgtgtcaattataaaca

SEQ ID NO: 234 - DNA, 20 bp, Artificial sequence
  Synthetic Oligonucleotide
tagaaagagtaagccttcac

SEQ ID NO: 235 - DNA, 20 bp, Artificial sequence
  Synthetic Oligonucleotide
agtgaggttactcaccagag

SEQ ID NO: 236 - DNA, 20 bp, Artificial sequence
  Synthetic Oligonucleotide
ttttgttgtgcagactgaaa

SEQ ID NO: 237 - DNA, 20 bp, Artificial sequence
  Synthetic Oligonucleotide
ttacccatcaaagcagtggg

SEQ ID NO: 238 - DNA, 20 bp, Artificial sequence
  Synthetic Oligonucleotide
aatgttgtgaataccatccc

SEQ ID NO: 239 - DNA, 20 bp, Artificial sequence
  Synthetic Oligonucleotide
taacatttctatgggcctga

SEQ ID NO: 240 - DNA, 20 bp, Artificial sequence
  Synthetic Oligonucleotide
tgtctactatttgaccaata

SEQ ID NO: 241 - DNA, 20 bp, Artificial sequence
  Synthetic Oligonucleotide
tttaaatgtgtcacttaatc

SEQ ID NO: 242 - DNA, 20 bp, Artificial sequence
  Synthetic Oligonucleotide
tcactaaaacaaaaatactt

SEQ ID NO: 243 - DNA, 20 bp, Artificial sequence
  Synthetic Oligonucleotide
tcttccaggccaaccacctt

SEQ ID NO: 244 - DNA, 20 bp, Artificial sequence
  Synthetic Oligonucleotide
tgcaaggcatgtgtgcacaa

SEQ ID NO: 245 - DNA, 20 bp, Artificial sequence
  Synthetic Oligonucleotide
tgtttaaaatatctctatac

SEQ ID NO: 246 - DNA, 20 bp, Artificial sequence
  Synthetic Oligonucleotide
catggaaaaattaagctcat

SEQ ID NO: 247 - DNA, 20 bp, Artificial sequence
  Synthetic Oligonucleotide
tgaagattctatttaacaaa

SEQ ID NO: 248 - DNA, 20 bp, Artificial sequence
  Synthetic Oligonucleotide
gcctaggagagaaaaataaa

SEQ ID NO: 249 - DNA, 20 bp, Artificial sequence
  Synthetic Oligonucleotide
ccagtgtaattcaaaggagc

SEQ ID NO: 250 - DNA, 20 bp, Artificial sequence
  Synthetic Oligonucleotide
ccattatttccatcacctgc

SEQ ID NO: 251 - DNA, 20 bp, Artificial sequence
  Synthetic Oligonucleotide
tacccaaattatacctggaa

SEQ ID NO: 252 - DNA, 20 bp, Artificial sequence
  Synthetic Oligonucleotide
agaggtaaagcaacttgccc

SEQ ID NO: 253 - DNA, 20 bp, Artificial sequence
  Synthetic Oligonucleotide
tccttaatagtcatagcagg

SEQ ID NO: 254 - DNA, 20 bp, Artificial sequence
  Synthetic Oligonucleotide
tcaccaccatttttcacatg

SEQ ID NO: 255 - DNA, 20 bp, Artificial sequence
  Synthetic Oligonucleotide
gttatggatatagactttaa

SEQ ID NO: 256 - DNA, 20 bp, Artificial sequence
  Synthetic Oligonucleotide
ctagaagcaatatttaaagc

SEQ ID NO: 257 - DNA, 20 bp, Artificial sequence
  Synthetic Oligonucleotide
atgaagtaagatgcttaaaa

SEQ ID NO: 258 - DNA, 20 bp, Artificial sequence
  Synthetic Oligonucleotide
cttcttgtctcagattacca

SEQ ID NO: 259 - DNA, 20 bp, Artificial sequence
  Synthetic Oligonucleotide
tctgaaaagccctccgagct

SEQ ID NO: 260 - DNA, 20 bp, Artificial sequence
  Synthetic Oligonucleotide
aagtgaatcagagcagtgta

SEQ ID NO: 261 - DNA, 20 bp, Artificial sequence
  Synthetic Oligonucleotide
accttacaagcatcttttcc

SEQ ID NO: 262 - DNA, 20 bp, Artificial sequence
  Synthetic Oligonucleotide
atttgttaaaagttgcttat

SEQ ID NO: 263 - DNA, 20 bp, Artificial sequence
  Synthetic Oligonucleotide
tgatatcatcatcccaatga

SEQ ID NO: 264 - DNA, 20 bp, Artificial sequence
  Synthetic Oligonucleotide
cagacaccttcttcacaagg

SEQ ID NO: 265 - DNA, 20 bp, Artificial sequence
  Synthetic Oligonucleotide
aatttcccagatgtattagt

SEQ ID NO: 266 - DNA, 20 bp, Artificial sequence
  Synthetic Oligonucleotide
tcagcagaaatcatgtaggc

SEQ ID NO: 267 - DNA, 20 bp, Artificial sequence
  Synthetic Oligonucleotide
ttaaatataaagagatcctc

SEQ ID NO: 268 - DNA, 20 bp, Artificial sequence
  Synthetic Oligonucleotide
gtaataaaaggaatgataaa

SEQ ID NO: 269 - DNA, 20 bp, Artificial sequence
  Synthetic Oligonucleotide
agacagtaaacaaaatcagg

SEQ ID NO: 270 - DNA, 20 bp, Artificial sequence
  Synthetic Oligonucleotide
caagaaaccaccaaaggaag

SEQ ID NO: 271 - DNA, 20 bp, Artificial sequence
  Synthetic Oligonucleotide
accccaacagacagcccacc

SEQ ID NO: 272 - DNA, 20 bp, Artificial sequence
  Synthetic Oligonucleotide
tgggctcaccccagtggacc

SEQ ID NO: 273 - DNA, 20 bp, Artificial sequence
  Synthetic Oligonucleotide
gcctggcccccaagactcta

SEQ ID NO: 274 - DNA, 20 bp, Artificial sequence
  Synthetic Oligonucleotide
aggcctgccacaggccagac

SEQ ID NO: 275 - DNA, 20 bp, Artificial sequence
  Synthetic Oligonucleotide
ttcaagcctgggcagcacag

SEQ ID NO: 276 - DNA, 20 bp, Artificial sequence
  Synthetic Oligonucleotide
aaaataacttcactagagct

SEQ ID NO: 277 - DNA, 20 bp, Artificial sequence
  Synthetic Oligonucleotide
tgttaagtatattaactatt

SEQ ID NO: 278 - DNA, 20 bp, Artificial sequence
  Synthetic Oligonucleotide
tactcaggaaattagaatat

SEQ ID NO: 279 - DNA, 20 bp, Artificial sequence
  Synthetic Oligonucleotide
ttatgaaacctcttgatttg

SEQ ID NO: 280 - DNA, 20 bp, Artificial sequence
  Synthetic Oligonucleotide
ttcttgtaaatgtctgaatt

SEQ ID NO: 281 - DNA, 20 bp, Artificial sequence
  Synthetic Oligonucleotide
accacaggaaactgtagcaa

SEQ ID NO: 282 - DNA, 20 bp, Artificial sequence
  Synthetic Oligonucleotide
gattggacccagacactata

SEQ ID NO: 283 - DNA, 20 bp, Artificial sequence
  Synthetic Oligonucleotide
cctcttaagtcaccatagac

SEQ ID NO: 284 - DNA, 20 bp, Artificial sequence
  Synthetic Oligonucleotide
ggttgagggacagacacagg

SEQ ID NO: 285 - DNA, 20 bp, Artificial sequence
  Synthetic Oligonucleotide
ataatcatgatttattttgc

SEQ ID NO: 286 - DNA, 20 bp, Artificial sequence
  Synthetic Oligonucleotide
cataagaatgtgcacacaaa

SEQ ID NO: 287 - DNA, 20 bp, Artificial sequence
  Synthetic Oligonucleotide
actcttattagctggtagaa

SEQ ID NO: 288 - DNA, 20 bp, Artificial sequence
  Synthetic Oligonucleotide
ggaccaaaactgagaggcag

SEQ ID NO: 289 - DNA, 20 bp, Artificial sequence
  Synthetic Oligonucleotide
ccattactctcaagctccac

SEQ ID NO: 290 - DNA, 20 bp, Artificial sequence
  Synthetic Oligonucleotide
atctattggttcaggagcca

SEQ ID NO: 291 - DNA, 20 bp, Artificial sequence
  Synthetic Oligonucleotide
gttaaaacaactagaagcca

SEQ ID NO: 292 - DNA, 20 bp, Artificial sequence
  Synthetic Oligonucleotide
aggtgttcttgcttatcctc

SEQ ID NO: 293 - DNA, 20 bp, Artificial sequence
  Synthetic Oligonucleotide
gcagtcactcctcttccagc

SEQ ID NO: 294 - DNA, 20 bp, Artificial sequence
  Synthetic Oligonucleotide
aagtgtattgcctagatttc

SEQ ID NO: 295 - DNA, 20 bp, Artificial sequence
  Synthetic Oligonucleotide
gagtgccatcttctctgcac

SEQ ID NO: 296 - DNA, 20 bp, Artificial sequence
  Synthetic Oligonucleotide
ttattcccagctctaaaata

SEQ ID NO: 297 - DNA, 20 bp, Artificial sequence
  Synthetic Oligonucleotide
ctcacaattctgtaagggaa

SEQ ID NO: 298 - DNA, 20 bp, Artificial sequence
  Synthetic Oligonucleotide
ataaaatatattaaggcaac

SEQ ID NO: 299 - DNA, 20 bp, Artificial sequence
  Synthetic Oligonucleotide
ttgagtcagacatcctgtga

SEQ ID NO: 300 - DNA, 20 bp, Artificial sequence
  Synthetic Oligonucleotide
taccttttctccatgtcatt

SEQ ID NO: 301 - DNA, 20 bp, Artificial sequence
  Synthetic Oligonucleotide
gggattttgctgaagctggt

SEQ ID NO: 302 - DNA, 20 bp, Artificial sequence
  Synthetic Oligonucleotide
ctttgaatagaaaatgacta

SEQ ID NO: 303 - DNA, 20 bp, Artificial sequence
  Synthetic Oligonucleotide
caaaatcacaagttctagat

SEQ ID NO: 304 - DNA, 20 bp, Artificial sequence
  Synthetic Oligonucleotide
tttccaatacttttacaaat

SEQ ID NO: 305 - DNA, 20 bp, Artificial sequence
  Synthetic Oligonucleotide
attaataagcatctctctga

SEQ ID NO: 306 - DNA, 20 bp, Artificial sequence
  Synthetic Oligonucleotide
tgactatccaatttctagtt

SEQ ID NO: 307 - DNA, 20 bp, Artificial sequence
  Synthetic Oligonucleotide
cttgtagtctgcacttaatg

SEQ ID NO: 308 - DNA, 20 bp, Artificial sequence
  Synthetic Oligonucleotide
acattttttaagtacaggaa

SEQ ID NO: 309 - DNA, 20 bp, Artificial sequence
  Synthetic Oligonucleotide
gaaatgtctagcattttcta

SEQ ID NO: 310 - DNA, 20 bp, Artificial sequence
  Synthetic Oligonucleotide
ccacttatttgatgaccaca

SEQ ID NO: 311 - DNA, 20 bp, Artificial sequence
  Synthetic Oligonucleotide
tccagaatactgccccatct

SEQ ID NO: 312 - DNA, 20 bp, Artificial sequence
  Synthetic Oligonucleotide
tggattcattttctgcaaat

SEQ ID NO: 313 - DNA, 20 bp, Artificial sequence
  Synthetic Oligonucleotide
agacattgtcaaatgtcccc

SEQ ID NO: 314 - DNA, 20 bp, Artificial sequence
  Synthetic Oligonucleotide
ttgatgtcagcactgttgac

SEQ ID NO: 315 - DNA, 20 bp, Artificial sequence
  Synthetic Oligonucleotide
acatcagtagcttcagatgt

SEQ ID NO: 316 - DNA, 20 bp, Artificial sequence
  Synthetic Oligonucleotide
caaaattaattgtgcataat

SEQ ID NO: 317 - DNA, 20 bp, Artificial sequence
  Synthetic Oligonucleotide
tttttctttaaattttgcta

SEQ ID NO: 318 - DNA, 20 bp, Artificial sequence
  Synthetic Oligonucleotide
tagagattttatgtacttgg

SEQ ID NO: 319 - DNA, 20 bp, Artificial sequence
  Synthetic Oligonucleotide
aaacacaggaatttgcagac

SEQ ID NO: 320 - DNA, 20 bp, Artificial sequence
  Synthetic Oligonucleotide
gtggaataaaccataatcta

SEQ ID NO: 321 - DNA, 20 bp, Artificial sequence
  Synthetic Oligonucleotide
gataattcttttcacagaca

SEQ ID NO: 322 - DNA, 20 bp, Artificial sequence
  Synthetic Oligonucleotide
cttctctatctcccagtgtt

SEQ ID NO: 323 - DNA, 20 bp, Artificial sequence
  Synthetic Oligonucleotide
caatacaggtaaatttcacg

SEQ ID NO: 324 - DNA, 20 bp, Artificial sequence
  Synthetic Oligonucleotide
aagggatttaaaatttttat

SEQ ID NO: 325 - DNA, 20 bp, Artificial sequence
  Synthetic Oligonucleotide
ggcaagctgtacaagaaaaa

SEQ ID NO: 326 - DNA, 20 bp, Artificial sequence
  Synthetic Oligonucleotide
tgtactcaccggtactctgc

SEQ ID NO: 327 - DNA, 20 bp, Artificial sequence
  Synthetic Oligonucleotide
aagagaatgctcagaaatgg

SEQ ID NO: 328 - DNA, 20 bp, Artificial sequence
  Synthetic Oligonucleotide
acacttgtaccccatacatc

SEQ ID NO: 329 - DNA, 20 bp, Artificial sequence
  Synthetic Oligonucleotide
gacagtagagactgggaagg

SEQ ID NO: 330 - DNA, 20 bp, Artificial sequence
  Synthetic Oligonucleotide
taccaatttctgaaagggca

SEQ ID NO: 331 - DNA, 20 bp, Artificial sequence
  Synthetic Oligonucleotide
cagagtaaactccccatctc

SEQ ID NO: 332 - DNA, 20 bp, Artificial sequence
  Synthetic Oligonucleotide
cttcaaagccagcagtgtaa

SEQ ID NO: 333 - DNA, 20 bp, Artificial sequence
  Synthetic Oligonucleotide
cttactgggctaaaatcaag

SEQ ID NO: 334 - DNA, 20 bp, Artificial sequence
  Synthetic Oligonucleotide
tatcactgtactagtttcct

SEQ ID NO: 335 - DNA, 20 bp, Artificial sequence
  Synthetic Oligonucleotide
ctgtactagtttcctataac

SEQ ID NO: 336 - DNA, 20 bp, Artificial sequence
  Synthetic Oligonucleotide
actgtactagtttcctataa

SEQ ID NO: 337 - DNA, 20 bp, Artificial sequence
  Synthetic Oligonucleotide
cactgtactagtttcctata

SEQ ID NO: 338 - DNA, 20 bp, Artificial sequence
  Synthetic Oligonucleotide
tcactgtactagtttcctat

SEQ ID NO: 339 - DNA, 20 bp, Artificial sequence
  Synthetic Oligonucleotide
atcactgtactagtttccta

SEQ ID NO: 340 - DNA, 20 bp, Artificial sequence
  Synthetic Oligonucleotide
gtggaatgtcatggcaattt

SEQ ID NO: 341 - DNA, 20 bp, Artificial sequence
  Synthetic Oligonucleotide
atgaacggtcttcaagctgt

SEQ ID NO: 342 - DNA, 20 bp, Artificial sequence
  Synthetic Oligonucleotide
aatgaacggtcttcaagctg

SEQ ID NO: 343 - DNA, 20 bp, Artificial sequence
  Synthetic Oligonucleotide
aaaatgaacggtcttcaagc

SEQ ID NO: 344 - DNA, 20 bp, Artificial sequence
  Synthetic Oligonucleotide
ttaaaaatgaacggtcttca

SEQ ID NO: 345 - DNA, 20 bp, Artificial sequence
  Synthetic Oligonucleotide
cacttaaaaatgaacggtct

SEQ ID NO: 346 - DNA, 20 bp, Artificial sequence
  Synthetic Oligonucleotide
tgagtctcttgtcacttaaa

SEQ ID NO: 347 - DNA, 20 bp, Artificial sequence
  Synthetic Oligonucleotide
gaggtgagtctcttgtcact

SEQ ID NO: 348 - DNA, 20 bp, Artificial sequence
  Synthetic Oligonucleotide
ggaggtgagtctcttgtcac

SEQ ID NO: 349 - DNA, 20 bp, Artificial sequence
  Synthetic Oligonucleotide
ttggaggtgagtctcttgtc

SEQ ID NO: 350 - DNA, 20 bp, Artificial sequence
  Synthetic Oligonucleotide
attgcttcttggaggtgagt

SEQ ID NO: 351 - DNA, 20 bp, Artificial sequence
  Synthetic Oligonucleotide
caattgcttcttggaggtga

SEQ ID NO: 352 - DNA, 20 bp, Artificial sequence
  Synthetic Oligonucleotide
cacaattgcttcttggaggt

SEQ ID NO: 353 - DNA, 20 bp, Artificial sequence
  Synthetic Oligonucleotide
acacaattgcttcttggagg

SEQ ID NO: 354 - DNA, 20 bp, Artificial sequence
  Synthetic Oligonucleotide
aaacacaattgcttcttgga

SEQ ID NO: 355 - DNA, 20 bp, Artificial sequence
  Synthetic Oligonucleotide
aaaacacaattgcttcttgg

SEQ ID NO: 356 - DNA, 20 bp, Artificial sequence
  Synthetic Oligonucleotide
gaaaacacaattgcttcttg

SEQ ID NO: 357 - DNA, 20 bp, Artificial sequence
  Synthetic Oligonucleotide
ttgcttgaataaaatcattc

SEQ ID NO: 358 - DNA, 20 bp, Artificial sequence
  Synthetic Oligonucleotide
gcttgcttgaataaaatcat

SEQ ID NO: 359 - DNA, 20 bp, Artificial sequence
  Synthetic Oligonucleotide
ttgcttgcttgaataaaatc

SEQ ID NO: 360 - DNA, 20 bp, Artificial sequence
  Synthetic Oligonucleotide
agttgcttgcttgaataaaa

SEQ ID NO: 361 - DNA, 20 bp, Artificial sequence
  Synthetic Oligonucleotide
gaaataagttgcttgcttga

SEQ ID NO: 362 - DNA, 20 bp, Artificial sequence
  Synthetic Oligonucleotide
aaatgaaataagttgcttgc

SEQ ID NO: 363 - DNA, 20 bp, Artificial sequence
  Synthetic Oligonucleotide
actgtagcaaacaaggaaat

SEQ ID NO: 364 - DNA, 20 bp, Artificial sequence
  Synthetic Oligonucleotide
ggaaactgtagcaaacaagg

SEQ ID NO: 365 - DNA, 20 bp, Artificial sequence
  Synthetic Oligonucleotide
cacaggaaactgtagcaaac

SEQ ID NO: 366 - DNA, 20 bp, Artificial sequence
  Synthetic Oligonucleotide
agacatccacaggaaactgt

SEQ ID NO: 367 - DNA, 20 bp, Artificial sequence
  Synthetic Oligonucleotide
gtcagacatccacaggaaac

SEQ ID NO: 368 - DNA, 20 bp, Artificial sequence
  Synthetic Oligonucleotide
tgagtcagacatccacagga

SEQ ID NO: 369 - DNA, 20 bp, Artificial sequence
  Synthetic Oligonucleotide
catagagttgagtcagacat

SEQ ID NO: 370 - DNA, 20 bp, Artificial sequence
  Synthetic Oligonucleotide
tcatagagttgagtcagaca

SEQ ID NO: 371 - DNA, 20 bp, Artificial sequence
  Synthetic Oligonucleotide
ttcatagagttgagtcagac

SEQ ID NO: 372 - DNA, 20 bp, Artificial sequence
  Synthetic Oligonucleotide
cgttttcatagagttgagtc

SEQ ID NO: 373 - DNA, 20 bp, Artificial sequence
  Synthetic Oligonucleotide
ccccacctctgaagaaggcg

SEQ ID NO: 374 - DNA, 20 bp, Artificial sequence
  Synthetic Oligonucleotide
catccccacctctgaagaag

SEQ ID NO: 375 - DNA, 20 bp, Artificial sequence
  Synthetic Oligonucleotide
agctacatccccacctctga

SEQ ID NO: 376 - DNA, 20 bp, Artificial sequence
  Synthetic Oligonucleotide
ggaagctacatccccacctc

SEQ ID NO: 377 - DNA, 20 bp, Artificial sequence
  Synthetic Oligonucleotide
atggaagctacatccccacc

SEQ ID NO: 378 - DNA, 20 bp, Artificial sequence
  Synthetic Oligonucleotide
tacatggaagctacatcccc

SEQ ID NO: 379 - DNA, 20 bp, Artificial sequence
  Synthetic Oligonucleotide
gtacatggaagctacatccc

SEQ ID NO: 380 - DNA, 20 bp, Artificial sequence
  Synthetic Oligonucleotide
gggtgtacatggaagctaca

SEQ ID NO: 381 - DNA, 20 bp, Artificial sequence
  Synthetic Oligonucleotide
tggcagtattgggcatttgg

SEQ ID NO: 382 - DNA, 20 bp, Artificial sequence
  Synthetic Oligonucleotide
catctggcagtattgggcat

SEQ ID NO: 383 - DNA, 20 bp, Artificial sequence
  Synthetic Oligonucleotide
ctcatctggcagtattgggc

SEQ ID NO: 384 - DNA, 20 bp, Artificial sequence
  Synthetic Oligonucleotide
cctcatctggcagtattggg

SEQ ID NO: 385 - DNA, 20 bp, Artificial sequence
  Synthetic Oligonucleotide
acctcatctggcagtattgg

SEQ ID NO: 386 - DNA, 20 bp, Artificial sequence
  Synthetic Oligonucleotide
tgcacctcatctggcagtat

SEQ ID NO: 387 - DNA, 20 bp, Artificial sequence
  Synthetic Oligonucleotide
gaatgtgcacctcatctggc

SEQ ID NO: 388 - DNA, 20 bp, Artificial sequence
  Synthetic Oligonucleotide
tggaatgtgcacctcatctg

SEQ ID NO: 389 - DNA, 20 bp, Artificial sequence
  Synthetic Oligonucleotide
gggtggaatgtgcacctcat

SEQ ID NO: 390 - DNA, 20 bp, Artificial sequence
  Synthetic Oligonucleotide
ttgggtggaatgtgcacctc

SEQ ID NO: 391 - DNA, 20 bp, Artificial sequence
  Synthetic Oligonucleotide
cttgggtggaatgtgcacct

SEQ ID NO: 392 - DNA, 20 bp, Artificial sequence
  Synthetic Oligonucleotide
tagcaaacaccttgggtgga

SEQ ID NO: 393 - DNA, 20 bp, Artificial sequence
  Synthetic Oligonucleotide
actgaatagcaaacaccttg

SEQ ID NO: 394 - DNA, 20 bp, Artificial sequence
  Synthetic Oligonucleotide
aaactgaatagcaaacacct

SEQ ID NO: 395 - DNA, 20 bp, Artificial sequence
  Synthetic Oligonucleotide
acttgctggaagaaaactga

SEQ ID NO: 396 - DNA, 20 bp, Artificial sequence
  Synthetic Oligonucleotide
gaacttgctggaagaaaact

SEQ ID NO: 397 - DNA, 20 bp, Artificial sequence
  Synthetic Oligonucleotide
tgattgaacttgctggaaga

SEQ ID NO: 398 - DNA, 20 bp, Artificial sequence
  Synthetic Oligonucleotide
cattgattgaacttgctgga

SEQ ID NO: 399 - DNA, 20 bp, Artificial sequence
  Synthetic Oligonucleotide
tcattgattgaacttgctgg

SEQ ID NO: 400 - DNA, 20 bp, Artificial sequence
  Synthetic Oligonucleotide
tgtcattgattgaacttgct

SEQ ID NO: 401 - DNA, 20 bp, Artificial sequence
  Synthetic Oligonucleotide
ccatgtcattgattgaactt

SEQ ID NO: 402 - DNA, 20 bp, Artificial sequence
  Synthetic Oligonucleotide
ctccatgtcattgattgaac

SEQ ID NO: 403 - DNA, 20 bp, Artificial sequence
  Synthetic Oligonucleotide
ttctccatgtcattgattga

SEQ ID NO: 404 - DNA, 20 bp, Artificial sequence
  Synthetic Oligonucleotide
cttttctccatgtcattgat

SEQ ID NO: 405 - DNA, 20 bp, Artificial sequence
  Synthetic Oligonucleotide
accaaaccttttctccatgt

SEQ ID NO: 406 - DNA, 20 bp, Artificial sequence
  Synthetic Oligonucleotide
gcaaccaaaccttttctcca

SEQ ID NO: 407 - DNA, 20 bp, Artificial sequence
  Synthetic Oligonucleotide
agcaaccaaaccttttctcc

SEQ ID NO: 408 - DNA, 20 bp, Artificial sequence
  Synthetic Oligonucleotide
gaagcaaccaaaccttttct

SEQ ID NO: 409 - DNA, 20 bp, Artificial sequence
  Synthetic Oligonucleotide
tcaagaagcaaccaaacctt

SEQ ID NO: 410 - DNA, 20 bp, Artificial sequence
  Synthetic Oligonucleotide
ctttcaagaagcaaccaaac

SEQ ID NO: 411 - DNA, 20 bp, Artificial sequence
  Synthetic Oligonucleotide
atctttcaagaagcaaccaa

SEQ ID NO: 412 - DNA, 20 bp, Artificial sequence
  Synthetic Oligonucleotide
ctatctttcaagaagcaacc

SEQ ID NO: 413 - DNA, 20 bp, Artificial sequence
  Synthetic Oligonucleotide
cactatctttcaagaagcaa

SEQ ID NO: 414 - DNA, 20 bp, Artificial sequence
  Synthetic Oligonucleotide
aacactatctttcaagaagc

SEQ ID NO: 415 - DNA, 20 bp, Artificial sequence
  Synthetic Oligonucleotide
atgtacttttggcagggttc

SEQ ID NO: 416 - DNA, 20 bp, Artificial sequence
  Synthetic Oligonucleotide
cgatgtacttttggcagggt

SEQ ID NO: 417 - DNA, 20 bp, Artificial sequence
  Synthetic Oligonucleotide
gttcgatgtacttttggcag

SEQ ID NO: 418 - DNA, 20 bp, Artificial sequence
  Synthetic Oligonucleotide
cctgttcgatgtacttttgg

SEQ ID NO: 419 - DNA, 20 bp, Artificial sequence
  Synthetic Oligonucleotide
gcacctgttcgatgtacttt

SEQ ID NO: 420 - DNA, 20 bp, Artificial sequence
  Synthetic Oligonucleotide
ctgcacctgttcgatgtact

SEQ ID NO: 421 - DNA, 20 bp, Artificial sequence
  Synthetic Oligonucleotide
aactgcacctgttcgatgta

SEQ ID NO: 422 - DNA, 20 bp, Artificial sequence
  Synthetic Oligonucleotide
gaaactgcacctgttcgatg

SEQ ID NO: 423 - DNA, 20 bp, Artificial sequence
  Synthetic Oligonucleotide
cagaaactgcacctgttcga

SEQ ID NO: 424 - DNA, 20 bp, Artificial sequence
  Synthetic Oligonucleotide
ccagaaactgcacctgttcg

SEQ ID NO: 425 - DNA, 20 bp, Artificial sequence
  Synthetic Oligonucleotide
tgtccagaaactgcacctgt

SEQ ID NO: 426 - DNA, 20 bp, Artificial sequence
  Synthetic Oligonucleotide
gaatgtccagaaactgcacc

SEQ ID NO: 427 - DNA, 20 bp, Artificial sequence
  Synthetic Oligonucleotide
aggaatgtccagaaactgca

SEQ ID NO: 428 - DNA, 20 bp, Artificial sequence
  Synthetic Oligonucleotide
tcaaggaatgtccagaaact

SEQ ID NO: 429 - DNA, 20 bp, Artificial sequence
  Synthetic Oligonucleotide
cttcaaggaatgtccagaaa

SEQ ID NO: 430 - DNA, 20 bp, Artificial sequence
  Synthetic Oligonucleotide
ttgcttcaaggaatgtccag

SEQ ID NO: 431 - DNA, 20 bp, Artificial sequence
  Synthetic Oligonucleotide
cattgcttcaaggaatgtcc

SEQ ID NO: 432 - DNA, 20 bp, Artificial sequence
  Synthetic Oligonucleotide
gaccacattgcttcaaggaa

SEQ ID NO: 433 - DNA, 20 bp, Artificial sequence
  Synthetic Oligonucleotide
tgaccacattgcttcaagga

SEQ ID NO: 434 - DNA, 20 bp, Artificial sequence
  Synthetic Oligonucleotide
atgaccacattgcttcaagg

SEQ ID NO: 435 - DNA, 20 bp, Artificial sequence
  Synthetic Oligonucleotide
ttgatgaccacattgcttca

SEQ ID NO: 436 - DNA, 20 bp, Artificial sequence
  Synthetic Oligonucleotide
atttgatgaccacattgctt

SEQ ID NO: 437 - DNA, 20 bp, Artificial sequence
  Synthetic Oligonucleotide
ttatttgatgaccacattgc

SEQ ID NO: 438 - DNA, 20 bp, Artificial sequence
  Synthetic Oligonucleotide
cttatttgatgaccacattg

SEQ ID NO: 439 - DNA, 20 bp, Artificial sequence
  Synthetic Oligonucleotide
cacttatttgatgaccacat

SEQ ID NO: 440 - DNA, 20 bp, Artificial sequence
  Synthetic Oligonucleotide
agcacttatttgatgaccac

SEQ ID NO: 441 - DNA, 20 bp, Artificial sequence
  Synthetic Oligonucleotide
caagcacttatttgatgacc

SEQ ID NO: 442 - DNA, 20 bp, Artificial sequence
  Synthetic Oligonucleotide
cgatggcaagcacttatttg

SEQ ID NO: 443 - DNA, 20 bp, Artificial sequence
  Synthetic Oligonucleotide
tgtctcgatggcaagcactt

SEQ ID NO: 444 - DNA, 20 bp, Artificial sequence
  Synthetic Oligonucleotide
atgtctcgatggcaagcact

SEQ ID NO: 445 - DNA, 20 bp, Artificial sequence
  Synthetic Oligonucleotide
aatgtctcgatggcaagcac

SEQ ID NO: 446 - DNA, 20 bp, Artificial sequence
  Synthetic Oligonucleotide
ttataaatgtctcgatggca

SEQ ID NO: 447 - DNA, 20 bp, Artificial sequence
  Synthetic Oligonucleotide
tttataaatgtctcgatggc

SEQ ID NO: 448 - DNA, 20 bp, Artificial sequence
  Synthetic Oligonucleotide
ctcctttataaatgtctcga

SEQ ID NO: 449 - DNA, 20 bp, Artificial sequence
  Synthetic Oligonucleotide
aactcctttataaatgtctc

SEQ ID NO: 450 - DNA, 20 bp, Artificial sequence
  Synthetic Oligonucleotide
tcaactcctttataaatgtc

SEQ ID NO: 451 - DNA, 20 bp, Artificial sequence
  Synthetic Oligonucleotide
tatcaactcctttataaatg

SEQ ID NO: 452 - DNA, 20 bp, Artificial sequence
  Synthetic Oligonucleotide
ctctcatatcaactccttta

SEQ ID NO: 453 - DNA, 20 bp, Artificial sequence
  Synthetic Oligonucleotide
ctcctctcatatcaactcct

SEQ ID NO: 454 - DNA, 20 bp, Artificial sequence
  Synthetic Oligonucleotide
gactcctctcatatcaactc

SEQ ID NO: 455 - DNA, 20 bp, Artificial sequence
  Synthetic Oligonucleotide
aattgactcctctcatatca

SEQ ID NO: 456 - DNA, 20 bp, Artificial sequence
  Synthetic Oligonucleotide
attaaaattgactcctctca

SEQ ID NO: 457 - DNA, 20 bp, Artificial sequence
  Synthetic Oligonucleotide
cattaaaattgactcctctc

SEQ ID NO: 458 - DNA, 20 bp, Artificial sequence
  Synthetic Oligonucleotide
cacattaaaattgactcctc

SEQ ID NO: 459 - DNA, 20 bp, Artificial sequence
  Synthetic Oligonucleotide
gacacattaaaattgactcc

SEQ ID NO: 460 - DNA, 20 bp, Artificial sequence
  Synthetic Oligonucleotide
agacacattaaaattgactc

SEQ ID NO: 461 - DNA, 20 bp, Artificial sequence
  Synthetic Oligonucleotide
accttagacacattaaaatt

SEQ ID NO: 462 - DNA, 20 bp, Artificial sequence
  Synthetic Oligonucleotide
gctaaccttagacacattaa

SEQ ID NO: 463 - DNA, 20 bp, Artificial sequence
  Synthetic Oligonucleotide
actgctaaccttagacacat

SEQ ID NO: 464 - DNA, 20 bp, Artificial sequence
  Synthetic Oligonucleotide
cactgctaaccttagacaca

SEQ ID NO: 465 - DNA, 20 bp, Artificial sequence
  Synthetic Oligonucleotide
acactgctaaccttagacac

SEQ ID NO: 466 - DNA, 20 bp, Artificial sequence
  Synthetic Oligonucleotide
cttcaacactgctaacctta

SEQ ID NO: 467 - DNA, 20 bp, Artificial sequence
  Synthetic Oligonucleotide
tcttcaacactgctaacctt

SEQ ID NO: 468 - DNA, 20 bp, Artificial sequence
  Synthetic Oligonucleotide
ggcattcttcaacactgcta

SEQ ID NO: 469 - DNA, 20 bp, Artificial sequence
  Synthetic Oligonucleotide
tggcattcttcaacactgct

SEQ ID NO: 470 - DNA, 20 bp, Artificial sequence
  Synthetic Oligonucleotide
tttggcattcttcaacactg

SEQ ID NO: 471 - DNA, 20 bp, Artificial sequence
  Synthetic Oligonucleotide
aaaactggcagcgaatgtta

SEQ ID NO: 472 - DNA, 20 bp, Artificial sequence
  Synthetic Oligonucleotide
ccggtactctgccttgtgaa

SEQ ID NO: 473 - DNA, 20 bp, Artificial sequence
  Synthetic Oligonucleotide
attgttccggtactctgcct

SEQ ID NO: 474 - DNA, 20 bp, Artificial sequence
  Synthetic Oligonucleotide
aattgttccggtactctgcc

SEQ ID NO: 475 - DNA, 20 bp, Artificial sequence
  Synthetic Oligonucleotide
caattgttccggtactctgc

SEQ ID NO: 476 - DNA, 20 bp, Artificial sequence
  Synthetic Oligonucleotide
aataggcaattgttccggta

SEQ ID NO: 477 - DNA, 20 bp, Artificial sequence
  Synthetic Oligonucleotide
taataggcaattgttccggt

SEQ ID NO: 478 - DNA, 20 bp, Artificial sequence
  Synthetic Oligonucleotide
ctttaataggcaattgttcc

SEQ ID NO: 479 - DNA, 20 bp, Artificial sequence
  Synthetic Oligonucleotide
gtactttaataggcaattgt

SEQ ID NO: 480 - DNA, 20 bp, Artificial sequence
  Synthetic Oligonucleotide
cgggactgtactttaatagg

SEQ ID NO: 481 - DNA, 20 bp, Artificial sequence
  Synthetic Oligonucleotide
cgttactcagcacctttata

SEQ ID NO: 482 - DNA, 20 bp, Artificial sequence
  Synthetic Oligonucleotide
gcttcagtgagaatccagat

SEQ ID NO: 483 - DNA, 20 bp, Artificial sequence
  Synthetic Oligonucleotide
ccaatttctgaaagggcaca

SEQ ID NO: 484 - DNA, 20 bp, Artificial sequence
  Synthetic Oligonucleotide
aaccaatttctgaaagggca

SEQ ID NO: 485 - DNA, 20 bp, Artificial sequence
  Synthetic Oligonucleotide
gcaaccaatttctgaaaggg

SEQ ID NO: 486 - DNA, 20 bp, Artificial sequence
  Synthetic Oligonucleotide
ggcaaccaatttctgaaagg

SEQ ID NO: 487 - DNA, 20 bp, Artificial sequence
  Synthetic Oligonucleotide
agatgctggaagatgttcat

SEQ ID NO: 488 - DNA, 20 bp, Artificial sequence
  Synthetic Oligonucleotide
caacatccacatctgagaac

SEQ ID NO: 489 - DNA, 20 bp, Artificial sequence
  Synthetic Oligonucleotide
ggcaacatccacatctgaga

SEQ ID NO: 490 - DNA, 20 bp, Artificial sequence
  Synthetic Oligonucleotide
ccctggcaacatccacatct

SEQ ID NO: 491 - DNA, 20 bp, Artificial sequence
  Synthetic Oligonucleotide
gaaccctggcaacatccaca

SEQ ID NO: 492 - DNA, 20 bp, Artificial sequence
  Synthetic Oligonucleotide
gagaaccctggcaacatcca

SEQ ID NO: 493 - DNA, 20 bp, Artificial sequence
  Synthetic Oligonucleotide
tgagaaccctggcaacatcc

SEQ ID NO: 494 - DNA, 20 bp, Artificial sequence
  Synthetic Oligonucleotide
ggagtgagaaccctggcaac

SEQ ID NO: 495 - DNA, 20 bp, Artificial sequence
  Synthetic Oligonucleotide
ctggagtgagaaccctggca

SEQ ID NO: 496 - DNA, 20 bp, Artificial sequence
  Synthetic Oligonucleotide
atctggagtgagaaccctgg

SEQ ID NO: 497 - DNA, 20 bp, Artificial sequence
  Synthetic Oligonucleotide
gcatctggagtgagaaccct

SEQ ID NO: 498 - DNA, 20 bp, Artificial sequence
  Synthetic Oligonucleotide
aagcatctggagtgagaacc

SEQ ID NO: 499 - DNA, 20 bp, Artificial sequence
  Synthetic Oligonucleotide
caaaagcatctggagtgaga

SEQ ID NO: 500 - DNA, 20 bp, Artificial sequence
  Synthetic Oligonucleotide
cacaaaagcatctggagtga

SEQ ID NO: 501 - DNA, 20 bp, Artificial sequence
  Synthetic Oligonucleotide
tggtccgacacacaaaagca

SEQ ID NO: 502 - DNA, 20 bp, Artificial sequence
  Synthetic Oligonucleotide
atggtccgacacacaaaagc

SEQ ID NO: 503 - DNA, 20 bp, Artificial sequence
  Synthetic Oligonucleotide
gatggtccgacacacaaaag

SEQ ID NO: 504 - DNA, 20 bp, Artificial sequence
  Synthetic Oligonucleotide
gcagatggtccgacacacaa

SEQ ID NO: 505 - DNA, 20 bp, Artificial sequence
  Synthetic Oligonucleotide
taggtgcagatggtccgaca

SEQ ID NO: 506 - DNA, 20 bp, Artificial sequence
  Synthetic Oligonucleotide
gataggtgcagatggtccga

SEQ ID NO: 507 - DNA, 20 bp, Artificial sequence
  Synthetic Oligonucleotide
gtgataggtgcagatggtcc

SEQ ID NO: 508 - DNA, 20 bp, Artificial sequence
  Synthetic Oligonucleotide
gggtgataggtgcagatggt

SEQ ID NO: 509 - DNA, 20 bp, Artificial sequence
  Synthetic Oligonucleotide
gaatgtaaagaagaggcagt

SEQ ID NO: 510 - DNA, 20 bp, Artificial sequence
  Synthetic Oligonucleotide
tagaatgtaaagaagaggca

SEQ ID NO: 511 - DNA, 20 bp, Artificial sequence
  Synthetic Oligonucleotide
catttgtatagaatgtaaag

SEQ ID NO: 512 - DNA, 20 bp, Artificial sequence
  Synthetic Oligonucleotide
tacatttgtatagaatgtaa

SEQ ID NO: 513 - DNA, 20 bp, Artificial sequence
  Synthetic Oligonucleotide
ccatacatttgtatagaatg

SEQ ID NO: 514 - DNA, 20 bp, Artificial sequence
  Synthetic Oligonucleotide
ctcgattttccatacatttg

SEQ ID NO: 515 - DNA, 20 bp, Artificial sequence
  Synthetic Oligonucleotide
tgactcgattttccatacat

SEQ ID NO: 516 - DNA, 20 bp, Artificial sequence
  Synthetic Oligonucleotide
gtgactcgattttccataca

SEQ ID NO: 517 - DNA, 20 bp, Artificial sequence
  Synthetic Oligonucleotide
tgtgactcgattttccatac

SEQ ID NO: 518 - DNA, 20 bp, Artificial sequence
  Synthetic Oligonucleotide
ctttgtgactcgattttcca

SEQ ID NO: 519 - DNA, 20 bp, Artificial sequence
  Synthetic Oligonucleotide
ttctttgtgactcgattttc

SEQ ID NO: 520 - DNA, 20 bp, Artificial sequence
  Synthetic Oligonucleotide
acatttctttgtgactcgat

SEQ ID NO: 521 - DNA, 20 bp, Artificial sequence
  Synthetic Oligonucleotide
aaacatttctttgtgactcg

SEQ ID NO: 522 - DNA, 20 bp, Artificial sequence
  Synthetic Oligonucleotide
tgtgccactttcagatgttt

SEQ ID NO: 523 - DNA, 20 bp, Artificial sequence
  Synthetic Oligonucleotide
gtgtgccactttcagatgtt

SEQ ID NO: 524 - DNA, 20 bp, Artificial sequence
  Synthetic Oligonucleotide
cttggtgtgccactttcaga

SEQ ID NO: 525 - DNA, 20 bp, Artificial sequence
  Synthetic Oligonucleotide
acttggtgtgccactttcag

SEQ ID NO: 526 - DNA, 20 bp, Artificial sequence
  Synthetic Oligonucleotide
aggaacttggtgtgccactt

SEQ ID NO: 527 - DNA, 20 bp, Artificial sequence
  Synthetic Oligonucleotide
tggtgttttcttgaggagta

SEQ ID NO: 528 - DNA, 20 bp, Artificial sequence
  Synthetic Oligonucleotide
atggtgttttcttgaggagt

SEQ ID NO: 529 - DNA, 20 bp, Artificial sequence
  Synthetic Oligonucleotide
tatggtgttttcttgaggag

SEQ ID NO: 530 - DNA, 20 bp, Artificial sequence
  Synthetic Oligonucleotide
cagatatggtgttttcttga

SEQ ID NO: 531 - DNA, 20 bp, Artificial sequence
  Synthetic Oligonucleotide
ccagatatggtgttttcttg

SEQ ID NO: 532 - DNA, 20 bp, Artificial sequence
  Synthetic Oligonucleotide
atccagatatggtgttttct

SEQ ID NO: 533 - DNA, 20 bp, Artificial sequence
  Synthetic Oligonucleotide
atatccagatatggtgtttt

SEQ ID NO: 534 - DNA, 20 bp, Artificial sequence
  Synthetic Oligonucleotide
ggctatatccagatatggtg

SEQ ID NO: 535 - DNA, 20 bp, Artificial sequence
  Synthetic Oligonucleotide
aaggctatatccagatatgg

SEQ ID NO: 536 - DNA, 20 bp, Artificial sequence
  Synthetic Oligonucleotide
gttaaaaggctatatccaga

SEQ ID NO: 537 - DNA, 20 bp, Artificial sequence
  Synthetic Oligonucleotide
caggttaaaaggctatatcc

SEQ ID NO: 538 - DNA, 20 bp, Artificial sequence
  Synthetic Oligonucleotide
tgcaggttaaaaggctatat

SEQ ID NO: 539 - DNA, 20 bp, Artificial sequence
  Synthetic Oligonucleotide
tttgcaggttaaaaggctat

SEQ ID NO: 540 - DNA, 20 bp, Artificial sequence
  Synthetic Oligonucleotide
cttttgcaggttaaaaggct

SEQ ID NO: 541 - DNA, 20 bp, Artificial sequence
  Synthetic Oligonucleotide
gttcttttgcaggttaaaag

SEQ ID NO: 542 - DNA, 20 bp, Artificial sequence
  Synthetic Oligonucleotide
aagttcttttgcaggttaaa

SEQ ID NO: 543 - DNA, 20 bp, Artificial sequence
  Synthetic Oligonucleotide
gtaaagttcttttgcaggtt

SEQ ID NO: 544 - DNA, 20 bp, Artificial sequence
  Synthetic Oligonucleotide
caggtaaagttcttttgcag

SEQ ID NO: 545 - DNA, 20 bp, Artificial sequence
  Synthetic Oligonucleotide
tcaggtaaagttcttttgca

SEQ ID NO: 546 - DNA, 20 bp, Artificial sequence
  Synthetic Oligonucleotide
gttcaggtaaagttcttttg

SEQ ID NO: 547 - DNA, 20 bp, Artificial sequence
  Synthetic Oligonucleotide
gggttcaggtaaagttcttt

SEQ ID NO: 548 - DNA, 20 bp, Artificial sequence
  Synthetic Oligonucleotide
cagggttcaggtaaagttct

SEQ ID NO: 549 - DNA, 20 bp, Artificial sequence
  Synthetic Oligonucleotide
gcagggttcaggtaaagttc

SEQ ID NO: 550 - DNA, 20 bp, Artificial sequence
  Synthetic Oligonucleotide
tggcagggttcaggtaaagt

SEQ ID NO: 551 - DNA, 20 bp, Artificial sequence
  Synthetic Oligonucleotide
gaatggcagggttcaggtaa

SEQ ID NO: 552 - DNA, 20 bp, Artificial sequence
  Synthetic Oligonucleotide
agaatggcagggttcaggta

SEQ ID NO: 553 - DNA, 20 bp, Artificial sequence
  Synthetic Oligonucleotide
tttagaatggcagggttcag

SEQ ID NO: 554 - DNA, 20 bp, Artificial sequence
  Synthetic Oligonucleotide
attttagaatggcagggttc

SEQ ID NO: 555 - DNA, 20 bp, Artificial sequence
  Synthetic Oligonucleotide
taaattttagaatggcaggg

SEQ ID NO: 556 - DNA, 20 bp, Artificial sequence
  Synthetic Oligonucleotide
agtcaactcccgggtaaatt

SEQ ID NO: 557 - DNA, 20 bp, Artificial sequence
  Synthetic Oligonucleotide
caaagtcaactcccgggtaa

SEQ ID NO: 558 - DNA, 20 bp, Artificial sequence
  Synthetic Oligonucleotide
ccaaagtcaactcccgggta

SEQ ID NO: 559 - DNA, 20 bp, Artificial sequence
  Synthetic Oligonucleotide
cctccaaagtcaactcccgg

SEQ ID NO: 560 - DNA, 20 bp, Artificial sequence
  Synthetic Oligonucleotide
ctcctccaaagtcaactccc

SEQ ID NO: 561 - DNA, 20 bp, Artificial sequence
  Synthetic Oligonucleotide
cttctcctccaaagtcaact

SEQ ID NO: 562 - DNA, 20 bp, Artificial sequence
  Synthetic Oligonucleotide
ttcaattcttctcctccaaa

SEQ ID NO: 563 - DNA, 20 bp, Artificial sequence
  Synthetic Oligonucleotide
cattcaattcttctcctcca

SEQ ID NO: 564 - DNA, 20 bp, Artificial sequence
  Synthetic Oligonucleotide
tcacattcaattcttctcct

SEQ ID NO: 565 - DNA, 20 bp, Artificial sequence
  Synthetic Oligonucleotide
agtcacattcaattcttctc

SEQ ID NO: 566 - DNA, 20 bp, Artificial sequence
  Synthetic Oligonucleotide
ggcaaacattcactccttta

SEQ ID NO: 567 - DNA, 20 bp, Artificial sequence
  Synthetic Oligonucleotide
tcttggcaaacattcactcc

SEQ ID NO: 568 - DNA, 20 bp, Artificial sequence
  Synthetic Oligonucleotide
gtctcttggcaaacattcac

SEQ ID NO: 569 - DNA, 20 bp, Artificial sequence
  Synthetic Oligonucleotide
caagtctcttggcaaacatt

SEQ ID NO: 570 - DNA, 20 bp, Artificial sequence
  Synthetic Oligonucleotide
tgcaagtctcttggcaaaca

SEQ ID NO: 571 - DNA, 20 bp, Artificial sequence
  Synthetic Oligonucleotide
ctttgtgcaagtctcttggc

SEQ ID NO: 572 - DNA, 20 bp, Artificial sequence
  Synthetic Oligonucleotide
catctttgtgcaagtctctt

SEQ ID NO: 573 - DNA, 20 bp, Artificial sequence
  Synthetic Oligonucleotide
tcatctttgtgcaagtctct

SEQ ID NO: 574 - DNA, 20 bp, Artificial sequence
  Synthetic Oligonucleotide
atcatctttgtgcaagtctc

SEQ ID NO: 575 - DNA, 20 bp, Artificial sequence
  Synthetic Oligonucleotide
acagcgaatcatctttgtgc

SEQ ID NO: 576 - DNA, 20 bp, Artificial sequence
  Synthetic Oligonucleotide
actgacagcgaatcatcttt

SEQ ID NO: 577 - DNA, 20 bp, Artificial sequence
  Synthetic Oligonucleotide
gaaaaactgacagcgaatca

SEQ ID NO: 578 - DNA, 20 bp, Artificial sequence
  Synthetic Oligonucleotide
gtgaaaaactgacagcgaat

SEQ ID NO: 579 - DNA, 20 bp, Artificial sequence
  Synthetic Oligonucleotide
ggagtaaagaataagtgaaa

SEQ ID NO: 580 - DNA, 20 bp, Artificial sequence
  Synthetic Oligonucleotide
tgggagtaaagaataagtga

SEQ ID NO: 581 - DNA, 20 bp, Artificial sequence
  Synthetic Oligonucleotide
tctgggagtaaagaataagt

SEQ ID NO: 582 - DNA, 20 bp, Artificial sequence
  Synthetic Oligonucleotide
gtcttctgggagtaaagaat

SEQ ID NO: 583 - DNA, 20 bp, Artificial sequence
  Synthetic Oligonucleotide
acagtcttctgggagtaaag

SEQ ID NO: 584 - DNA, 20 bp, Artificial sequence
  Synthetic Oligonucleotide
cttacagtcttctgggagta

SEQ ID NO: 585 - DNA, 20 bp, Artificial sequence
  Synthetic Oligonucleotide
ccttacagtcttctgggagt

SEQ ID NO: 586 - DNA, 20 bp, Artificial sequence
  Synthetic Oligonucleotide
tccttacagtcttctgggag

SEQ ID NO: 587 - DNA, 20 bp, Artificial sequence
  Synthetic Oligonucleotide
cttccttacagtcttctggg

SEQ ID NO: 588 - DNA, 20 bp, Artificial sequence
  Synthetic Oligonucleotide
cacttacacttctcttcctt

SEQ ID NO: 589 - DNA, 20 bp, Artificial sequence
  Synthetic Oligonucleotide
acacttacacttctcttcct

SEQ ID NO: 590 - DNA, 20 bp, Artificial sequence
  Synthetic Oligonucleotide
agaaacacttacacttctct

SEQ ID NO: 591 - DNA, 20 bp, Artificial sequence
  Synthetic Oligonucleotide
cttaagaaacacttacactt

SEQ ID NO: 592 - DNA, 20 bp, Artificial sequence
  Synthetic Oligonucleotide
ccatagataatcttaagaaa

SEQ ID NO: 593 - DNA, 20 bp, Artificial sequence
  Synthetic Oligonucleotide
catccatagataatcttaag

SEQ ID NO: 594 - DNA, 20 bp, Artificial sequence
  Synthetic Oligonucleotide
accatccatagataatctta

SEQ ID NO: 595 - DNA, 20 bp, Artificial sequence
  Synthetic Oligonucleotide
gaaccatccatagataatct

SEQ ID NO: 596 - DNA, 20 bp, Artificial sequence
  Synthetic Oligonucleotide
tggagaaccatccatagata

SEQ ID NO: 597 - DNA, 20 bp, Artificial sequence
  Synthetic Oligonucleotide
tgtgtcccatacgcaatcct

SEQ ID NO: 598 - DNA, 20 bp, Artificial sequence
  Synthetic Oligonucleotide
cccttgtgtcccatacgcaa

SEQ ID NO: 599 - DNA, 20 bp, Artificial sequence
  Synthetic Oligonucleotide
gctcccttgtgtcccatacg

SEQ ID NO: 600 - DNA, 20 bp, Artificial sequence
  Synthetic Oligonucleotide
agagctcccttgtgtcccat

SEQ ID NO: 601 - DNA, 20 bp, Artificial sequence
  Synthetic Oligonucleotide
ccagagctcccttgtgtccc

SEQ ID NO: 602 - DNA, 20 bp, Artificial sequence
  Synthetic Oligonucleotide
taaccagagctcccttgtgt

SEQ ID NO: 603 - DNA, 20 bp, Artificial sequence
  Synthetic Oligonucleotide
gtaaccagagctcccttgtg

SEQ ID NO: 604 - DNA, 20 bp, Artificial sequence
  Synthetic Oligonucleotide
gagtaaccagagctcccttg

SEQ ID NO: 605 - DNA, 20 bp, Artificial sequence
  Synthetic Oligonucleotide
aagagtaaccagagctccct

SEQ ID NO: 606 - DNA, 20 bp, Artificial sequence
  Synthetic Oligonucleotide
tcaaagagtaaccagagctc

SEQ ID NO: 607 - DNA, 20 bp, Artificial sequence
  Synthetic Oligonucleotide
tctcaaagagtaaccagagc

SEQ ID NO: 608 - DNA, 20 bp, Artificial sequence
  Synthetic Oligonucleotide
aatctcaaagagtaaccaga

SEQ ID NO: 609 - DNA, 20 bp, Artificial sequence
  Synthetic Oligonucleotide
caatctcaaagagtaaccag

SEQ ID NO: 610 - DNA, 20 bp, Artificial sequence
  Synthetic Oligonucleotide
cacaatctcaaagagtaacc

SEQ ID NO: 611 - DNA, 20 bp, Artificial sequence
  Synthetic Oligonucleotide
gttacacaatctcaaagagt

SEQ ID NO: 612 - DNA, 20 bp, Artificial sequence
  Synthetic Oligonucleotide
cagtgttacacaatctcaaa

SEQ ID NO: 613 - DNA, 20 bp, Artificial sequence
  Synthetic Oligonucleotide
cccagtgttacacaatctca

SEQ ID NO: 614 - DNA, 20 bp, Artificial sequence
  Synthetic Oligonucleotide
gtccccagtgttacacaatc

SEQ ID NO: 615 - DNA, 20 bp, Artificial sequence
  Synthetic Oligonucleotide
gttgtccccagtgttacaca

SEQ ID NO: 616 - DNA, 20 bp, Artificial sequence
  Synthetic Oligonucleotide
gtttgttcctccaacaatgc

SEQ ID NO: 617 - DNA, 20 bp, Artificial sequence
  Synthetic Oligonucleotide
agagtttgttcctccaacaa

SEQ ID NO: 618 - DNA, 20 bp, Artificial sequence
  Synthetic Oligonucleotide
caagaagagtttgttcctcc

SEQ ID NO: 619 - DNA, 20 bp, Artificial sequence
  Synthetic Oligonucleotide
ccccaagaagagtttgttcc

SEQ ID NO: 620 - DNA, 20 bp, Artificial sequence
  Synthetic Oligonucleotide
ctccccaagaagagtttgtt

SEQ ID NO: 621 - DNA, 20 bp, Artificial sequence
  Synthetic Oligonucleotide
ctctccccaagaagagtttg

SEQ ID NO: 622 - DNA, 20 bp, Artificial sequence
  Synthetic Oligonucleotide
gggccactctccccaagaag

SEQ ID NO: 623 - DNA, 20 bp, Artificial sequence
  Synthetic Oligonucleotide
cagggccactctccccaaga

SEQ ID NO: 624 - DNA, 20 bp, Artificial sequence
  Synthetic Oligonucleotide
tctgagctgtcagcttcacc

SEQ ID NO: 625 - DNA, 20 bp, Artificial sequence
  Synthetic Oligonucleotide
gcctctgagctgtcagcttc

SEQ ID NO: 626 - DNA, 20 bp, Artificial sequence
  Synthetic Oligonucleotide
tcctatgagtgaccctccac

SEQ ID NO: 627 - DNA, 20 bp, Artificial sequence
  Synthetic Oligonucleotide
gtcctatgagtgaccctcca

SEQ ID NO: 628 - DNA, 20 bp, Artificial sequence
  Synthetic Oligonucleotide
ggtgtcctatgagtgaccct

SEQ ID NO: 629 - DNA, 20 bp, Artificial sequence
  Synthetic Oligonucleotide
tggtgtcctatgagtgaccc

SEQ ID NO: 630 - DNA, 20 bp, Artificial sequence
  Synthetic Oligonucleotide
ccactggtgtcctatgagtg

SEQ ID NO: 631 - DNA, 20 bp, Artificial sequence
  Synthetic Oligonucleotide
cccactggtgtcctatgagt

SEQ ID NO: 632 - DNA, 20 bp, Artificial sequence
  Synthetic Oligonucleotide
gaagcccatcaaagcagtgg

SEQ ID NO: 633 - DNA, 20 bp, Artificial sequence
  Synthetic Oligonucleotide
tatagatgcgccaaacatcc

SEQ ID NO: 634 - DNA, 20 bp, Artificial sequence
  Synthetic Oligonucleotide
ctatagatgcgccaaacatc

SEQ ID NO: 635 - DNA, 20 bp, Artificial sequence
  Synthetic Oligonucleotide
gccactatagatgcgccaaa

SEQ ID NO: 636 - DNA, 20 bp, Artificial sequence
  Synthetic Oligonucleotide
atgccactatagatgcgcca

SEQ ID NO: 637 - DNA, 20 bp, Artificial sequence
  Synthetic Oligonucleotide
taatgtctgacagatttaaa

SEQ ID NO: 638 - DNA, 20 bp, Artificial sequence
  Synthetic Oligonucleotide
ttgtaatgtctgacagattt

SEQ ID NO: 639 - DNA, 20 bp, Artificial sequence
  Synthetic Oligonucleotide
tgagaaaggtgtatcttttg

SEQ ID NO: 640 - DNA, 20 bp, Artificial sequence
  Synthetic Oligonucleotide
ttgtgagaaaggtgtatctt

SEQ ID NO: 641 - DNA, 20 bp, Artificial sequence
  Synthetic Oligonucleotide
tttgtgagaaaggtgtatct

SEQ ID NO: 642 - DNA, 20 bp, Artificial sequence
  Synthetic Oligonucleotide
atttgtgagaaaggtgtatc

SEQ ID NO: 643 - DNA, 20 bp, Artificial sequence
  Synthetic Oligonucleotide
ttatttgtgagaaaggtgta

SEQ ID NO: 644 - DNA, 20 bp, Artificial sequence
  Synthetic Oligonucleotide
ttttatttgtgagaaaggtg

SEQ ID NO: 645 - DNA, 20 bp, Artificial sequence
  Synthetic Oligonucleotide
cttttatttgtgagaaaggt

SEQ ID NO: 646 - DNA, 20 bp, Artificial sequence
  Synthetic Oligonucleotide
ctcttttatttgtgagaaag

SEQ ID NO: 647 - DNA, 20 bp, Artificial sequence
  Synthetic Oligonucleotide
ttggtgaataataatctctt

SEQ ID NO: 648 - DNA, 20 bp, Artificial sequence
  Synthetic Oligonucleotide
tttggtgaataataatctct

SEQ ID NO: 649 - DNA, 20 bp, Artificial sequence
  Synthetic Oligonucleotide
gttttggtgaataataatct

SEQ ID NO: 650 - DNA, 20 bp, Artificial sequence
  Synthetic Oligonucleotide
tatagttttggtgaataata

SEQ ID NO: 651 - DNA, 20 bp, Artificial sequence
  Synthetic Oligonucleotide
actttatagttttggtgaat

SEQ ID NO: 652 - DNA, 20 bp, Artificial sequence
  Synthetic Oligonucleotide
cccttctgagactttatagt

SEQ ID NO: 653 - DNA, 20 bp, Artificial sequence
  Synthetic Oligonucleotide
gattcccttctgagacttta

SEQ ID NO: 654 - DNA, 20 bp, Artificial sequence
  Synthetic Oligonucleotide
catgattcccttctgagact

SEQ ID NO: 655 - DNA, 20 bp, Artificial sequence
  Synthetic Oligonucleotide
tcatgattcccttctgagac

SEQ ID NO: 656 - DNA, 20 bp, Artificial sequence
  Synthetic Oligonucleotide
tatcatgattcccttctgag

SEQ ID NO: 657 - DNA, 20 bp, Artificial sequence
  Synthetic Oligonucleotide
atatcatgattcccttctga

SEQ ID NO: 658 - DNA, 20 bp, Artificial sequence
  Synthetic Oligonucleotide
gcgatatcatgattcccttc

SEQ ID NO: 659 - DNA, 20 bp, Artificial sequence
  Synthetic Oligonucleotide
ggcgatatcatgattccctt

SEQ ID NO: 660 - DNA, 20 bp, Artificial sequence
  Synthetic Oligonucleotide
aaggcgatatcatgattccc

SEQ ID NO: 661 - DNA, 20 bp, Artificial sequence
  Synthetic Oligonucleotide
tatcaaggcgatatcatgat

SEQ ID NO: 662 - DNA, 20 bp, Artificial sequence
  Synthetic Oligonucleotide
gagttttatcaaggcgatat

SEQ ID NO: 663 - DNA, 20 bp, Artificial sequence
  Synthetic Oligonucleotide
ctggagttttatcaaggcga

SEQ ID NO: 664 - DNA, 20 bp, Artificial sequence
  Synthetic Oligonucleotide
gcctggagttttatcaaggc

SEQ ID NO: 665 - DNA, 20 bp, Artificial sequence
  Synthetic Oligonucleotide
aggagcctggagttttatca

SEQ ID NO: 666 - DNA, 20 bp, Artificial sequence
  Synthetic Oligonucleotide
attcaaaggagcctggagtt

SEQ ID NO: 667 - DNA, 20 bp, Artificial sequence
  Synthetic Oligonucleotide
gtaattcaaaggagcctgga

SEQ ID NO: 668 - DNA, 20 bp, Artificial sequence
  Synthetic Oligonucleotide
gtgtaattcaaaggagcctg

SEQ ID NO: 669 - DNA, 20 bp, Artificial sequence
  Synthetic Oligonucleotide
cagtgtaattcaaaggagcc

SEQ ID NO: 670 - DNA, 20 bp, Artificial sequence
  Synthetic Oligonucleotide
taggcatattggtttttgga

SEQ ID NO: 671 - DNA, 20 bp, Artificial sequence
  Synthetic Oligonucleotide
ggtaggcatattggtttttg

SEQ ID NO: 672 - DNA, 20 bp, Artificial sequence
  Synthetic Oligonucleotide
gaaggtaggcatattggttt

SEQ ID NO: 673 - DNA, 20 bp, Artificial sequence
  Synthetic Oligonucleotide
cttgtgtcacctttggaagg

SEQ ID NO: 674 - DNA, 20 bp, Artificial sequence
  Synthetic Oligonucleotide
gcttgtgtcacctttggaag

SEQ ID NO: 675 - DNA, 20 bp, Artificial sequence
  Synthetic Oligonucleotide
gtgcttgtgtcacctttgga

SEQ ID NO: 676 - DNA, 20 bp, Artificial sequence
  Synthetic Oligonucleotide
aaattgtgcttgtgtcacct

SEQ ID NO: 677 - DNA, 20 bp, Artificial sequence
  Synthetic Oligonucleotide
gtataaattgtgcttgtgtc

SEQ ID NO: 678 - DNA, 20 bp, Artificial sequence
  Synthetic Oligonucleotide
ggtataaattgtgcttgtgt

SEQ ID NO: 679 - DNA, 20 bp, Artificial sequence
  Synthetic Oligonucleotide
tggtataaattgtgcttgtg

SEQ ID NO: 680 - DNA, 20 bp, Artificial sequence
  Synthetic Oligonucleotide
gttggtataaattgtgcttg

SEQ ID NO: 681 - DNA, 20 bp, Artificial sequence
  Synthetic Oligonucleotide
cagttggtataaattgtgct

SEQ ID NO: 682 - DNA, 20 bp, Artificial sequence
  Synthetic Oligonucleotide
cccaacagttggtataaatt

SEQ ID NO: 683 - DNA, 20 bp, Artificial sequence
  Synthetic Oligonucleotide
ttacccaacagttggtataa

SEQ ID NO: 684 - DNA, 20 bp, Artificial sequence
  Synthetic Oligonucleotide
ggttacccaacagttggtat

SEQ ID NO: 685 - DNA, 20 bp, Artificial sequence
  Synthetic Oligonucleotide
gaagccccatccggttaccc

SEQ ID NO: 686 - DNA, 20 bp, Artificial sequence
  Synthetic Oligonucleotide
tcgagaagccccatccggtt

SEQ ID NO: 687 - DNA, 20 bp, Artificial sequence
  Synthetic Oligonucleotide
ccttcgagaagccccatccg

SEQ ID NO: 688 - DNA, 20 bp, Artificial sequence
  Synthetic Oligonucleotide
tttctccttcgagaagcccc

SEQ ID NO: 689 - DNA, 20 bp, Artificial sequence
  Synthetic Oligonucleotide
cctttctccttcgagaagcc

SEQ ID NO: 690 - DNA, 20 bp, Artificial sequence
  Synthetic Oligonucleotide
tcacctttctccttcgagaa

SEQ ID NO: 691 - DNA, 20 bp, Artificial sequence
  Synthetic Oligonucleotide
ttcacctttctccttcgaga

SEQ ID NO: 692 - DNA, 20 bp, Artificial sequence
  Synthetic Oligonucleotide
tttggatttcacctttctcc

SEQ ID NO: 693 - DNA, 20 bp, Artificial sequence
  Synthetic Oligonucleotide
tgtagaatattttggatttc

SEQ ID NO: 694 - DNA, 20 bp, Artificial sequence
  Synthetic Oligonucleotide
tttgttaccaaaggaatatt

SEQ ID NO: 695 - DNA, 20 bp, Artificial sequence
  Synthetic Oligonucleotide
catttgttaccaaaggaata

SEQ ID NO: 696 - DNA, 20 bp, Artificial sequence
  Synthetic Oligonucleotide
tcatttgttaccaaaggaat

SEQ ID NO: 697 - DNA, 20 bp, Artificial sequence
  Synthetic Oligonucleotide
tcttcatttgttaccaaagg

SEQ ID NO: 698 - DNA, 20 bp, Artificial sequence
  Synthetic Oligonucleotide
cattcttcatttgttaccaa

SEQ ID NO: 699 - DNA, 20 bp, Artificial sequence
  Synthetic Oligonucleotide
cttgatatcttttctggcat

SEQ ID NO: 700 - DNA, 20 bp, Artificial sequence
  Synthetic Oligonucleotide
taatcttgatatcttttctg

SEQ ID NO: 701 - DNA, 20 bp, Artificial sequence
  Synthetic Oligonucleotide
tataatcttgatatcttttc

SEQ ID NO: 702 - DNA, 20 bp, Artificial sequence
  Synthetic Oligonucleotide
ttctttatagccagcacaga

SEQ ID NO: 703 - DNA, 20 bp, Artificial sequence
  Synthetic Oligonucleotide
ccttctttatagccagcaca

SEQ ID NO: 704 - DNA, 20 bp, Artificial sequence
  Synthetic Oligonucleotide
ccccttctttatagccagca

SEQ ID NO: 705 - DNA, 20 bp, Artificial sequence
  Synthetic Oligonucleotide
cccccttctttatagccagc

SEQ ID NO: 706 - DNA, 20 bp, Artificial sequence
  Synthetic Oligonucleotide
tcccccttctttatagccag

SEQ ID NO: 707 - DNA, 20 bp, Artificial sequence
  Synthetic Oligonucleotide
caagcatcttttcccccttc

SEQ ID NO: 708 - DNA, 20 bp, Artificial sequence
  Synthetic Oligonucleotide
agggaccacctgaatctccc

SEQ ID NO: 709 - DNA, 20 bp, Artificial sequence
  Synthetic Oligonucleotide
ctaagggaccacctgaatct

SEQ ID NO: 710 - DNA, 20 bp, Artificial sequence
  Synthetic Oligonucleotide
actaagggaccacctgaatc

SEQ ID NO: 711 - DNA, 20 bp, Artificial sequence
  Synthetic Oligonucleotide
caaactaagggaccacctga

SEQ ID NO: 712 - DNA, 20 bp, Artificial sequence
  Synthetic Oligonucleotide
gcaaactaagggaccacctg

SEQ ID NO: 713 - DNA, 20 bp, Artificial sequence
  Synthetic Oligonucleotide
tgcaaactaagggaccacct

SEQ ID NO: 714 - DNA, 20 bp, Artificial sequence
  Synthetic Oligonucleotide
gtgtttgcaaactaagggac

SEQ ID NO: 715 - DNA, 20 bp, Artificial sequence
  Synthetic Oligonucleotide
tgtgtttgcaaactaaggga

SEQ ID NO: 716 - DNA, 20 bp, Artificial sequence
  Synthetic Oligonucleotide
ccctgcgggcacagccttca

SEQ ID NO: 717 - DNA, 20 bp, Artificial sequence
  Synthetic Oligonucleotide
ttgctccctgcgggcacagc

SEQ ID NO: 718 - DNA, 20 bp, Artificial sequence
  Synthetic Oligonucleotide
caccaggttgctccctgcgg

SEQ ID NO: 719 - DNA, 20 bp, Artificial sequence
  Synthetic Oligonucleotide
acaccaggttgctccctgcg

SEQ ID NO: 720 - DNA, 20 bp, Artificial sequence
  Synthetic Oligonucleotide
agacaccaggttgctccctg

SEQ ID NO: 721 - DNA, 20 bp, Artificial sequence
  Synthetic Oligonucleotide
gtagacaccaggttgctccc

SEQ ID NO: 722 - DNA, 20 bp, Artificial sequence
  Synthetic Oligonucleotide
ctcagcgactttggtgtaga

SEQ ID NO: 723 - DNA, 20 bp, Artificial sequence
  Synthetic Oligonucleotide
gtactcagcgactttggtgt

SEQ ID NO: 724 - DNA, 20 bp, Artificial sequence
  Synthetic Oligonucleotide
catgtactcagcgactttgg

SEQ ID NO: 725 - DNA, 20 bp, Artificial sequence
  Synthetic Oligonucleotide
cagtccatgtactcagcgac

SEQ ID NO: 726 - DNA, 20 bp, Artificial sequence
  Synthetic Oligonucleotide
tccagtccatgtactcagcg

SEQ ID NO: 727 - DNA, 20 bp, Artificial sequence
  Synthetic Oligonucleotide
gcttttccatcactgctctg

SEQ ID NO: 728 - DNA, 20 bp, Artificial sequence
  Synthetic Oligonucleotide
ctgagcttttccatcactgc

SEQ ID NO: 729 - DNA, 20 bp, Artificial sequence
  Synthetic Oligonucleotide
tctgagcttttccatcactg

SEQ ID NO: 730 - DNA, 20 bp, Artificial sequence
  Synthetic Oligonucleotide
gcatctgagcttttccatca

SEQ ID NO: 731 - DNA, 20 bp, Artificial sequence
  Synthetic Oligonucleotide
actgcatctgagcttttcca

SEQ ID NO: 732 - DNA, 20 bp, Artificial sequence
  Synthetic Oligonucleotide
tggtgactgcatctgagctt

SEQ ID NO: 733 - DNA, 20 bp, Artificial sequence
  Synthetic Oligonucleotide
gctggtgactgcatctgagc

SEQ ID NO: 734 - DNA, 20 bp, Artificial sequence
  Synthetic Oligonucleotide
atgctggtgactgcatctga

SEQ ID NO: 735 - DNA, 20 bp, Artificial sequence
  Synthetic Oligonucleotide
tcatgctggtgactgcatct

SEQ ID NO: 736 - DNA, 20 bp, Artificial sequence
  Synthetic Oligonucleotide
cttctcatgctggtgactgc

SEQ ID NO: 737 - DNA, 20 bp, Artificial sequence
  Synthetic Oligonucleotide
actgcttctcatgctggtga

SEQ ID NO: 738 - DNA, 20 bp, Artificial sequence
  Synthetic Oligonucleotide
ggactgcttctcatgctggt

SEQ ID NO: 739 - DNA, 20 bp, Artificial sequence
  Synthetic Oligonucleotide
ctggactgcttctcatgctg

SEQ ID NO: 740 - DNA, 20 bp, Artificial sequence
  Synthetic Oligonucleotide
ctctggactgcttctcatgc

SEQ ID NO: 741 - DNA, 20 bp, Artificial sequence
  Synthetic Oligonucleotide
agactctggactgcttctca

SEQ ID NO: 742 - DNA, 20 bp, Artificial sequence
  Synthetic Oligonucleotide
cctagactctggactgcttc

SEQ ID NO: 743 - DNA, 20 bp, Artificial sequence
  Synthetic Oligonucleotide
tgcctagactctggactgct

SEQ ID NO: 744 - DNA, 20 bp, Artificial sequence
  Synthetic Oligonucleotide
attgcctagactctggactg

SEQ ID NO: 745 - DNA, 20 bp, Artificial sequence
  Synthetic Oligonucleotide
aaaaattgcctagactctgg

SEQ ID NO: 746 - DNA, 20 bp, Artificial sequence
  Synthetic Oligonucleotide
ggttgtaaaaattgcctaga

SEQ ID NO: 747 - DNA, 20 bp, Artificial sequence
  Synthetic Oligonucleotide
tcaggttgtaaaaattgcct

SEQ ID NO: 748 - DNA, 20 bp, Artificial sequence
  Synthetic Oligonucleotide
ctcaggttgtaaaaattgcc

SEQ ID NO: 749 - DNA, 20 bp, Artificial sequence
  Synthetic Oligonucleotide
actcaggttgtaaaaattgc

SEQ ID NO: 750 - DNA, 20 bp, Artificial sequence
  Synthetic Oligonucleotide
gaactcaggttgtaaaaatt

SEQ ID NO: 751 - DNA, 20 bp, Artificial sequence
  Synthetic Oligonucleotide
acttgaactcaggttgtaaa

SEQ ID NO: 752 - DNA, 20 bp, Artificial sequence
  Synthetic Oligonucleotide
gacttgaactcaggttgtaa

SEQ ID NO: 753 - DNA, 20 bp, Artificial sequence
  Synthetic Oligonucleotide
gaatttgacttgaactcagg

SEQ ID NO: 754 - DNA, 20 bp, Artificial sequence
  Synthetic Oligonucleotide
ctcagaatttgacttgaact

SEQ ID NO: 755 - DNA, 20 bp, Artificial sequence
  Synthetic Oligonucleotide
aggctcagaatttgacttga

SEQ ID NO: 756 - DNA, 20 bp, Artificial sequence
  Synthetic Oligonucleotide
caggctcagaatttgacttg

SEQ ID NO: 757 - DNA, 20 bp, Artificial sequence
  Synthetic Oligonucleotide
ccaggctcagaatttgactt

SEQ ID NO: 758 - DNA, 20 bp, Artificial sequence
  Synthetic Oligonucleotide
ccccaggctcagaatttgac

SEQ ID NO: 759 - DNA, 20 bp, Artificial sequence
  Synthetic Oligonucleotide
ccccccaggctcagaatttg

SEQ ID NO: 760 - DNA, 20 bp, Artificial sequence
  Synthetic Oligonucleotide
gaccccccaggctcagaatt

SEQ ID NO: 761 - DNA, 20 bp, Artificial sequence
  Synthetic Oligonucleotide
atgaggaccccccaggctca

SEQ ID NO: 762 - DNA, 20 bp, Artificial sequence
  Synthetic Oligonucleotide
gatgaggaccccccaggctc

SEQ ID NO: 763 - DNA, 20 bp, Artificial sequence
  Synthetic Oligonucleotide
gcagatgaggaccccccagg

SEQ ID NO: 764 - DNA, 20 bp, Artificial sequence
  Synthetic Oligonucleotide
tgcagatgaggaccccccag

SEQ ID NO: 765 - DNA, 20 bp, Artificial sequence
  Synthetic Oligonucleotide
tttgcagatgaggacccccc

SEQ ID NO: 766 - DNA, 20 bp, Artificial sequence
  Synthetic Oligonucleotide
ctccatgctttgcagatgag

SEQ ID NO: 767 - DNA, 20 bp, Artificial sequence
  Synthetic Oligonucleotide
gccactctccatgctttgca

SEQ ID NO: 768 - DNA, 20 bp, Artificial sequence
  Synthetic Oligonucleotide
agatgccactctccatgctt

SEQ ID NO: 769 - DNA, 20 bp, Artificial sequence
  Synthetic Oligonucleotide
gaagatgccactctccatgc

SEQ ID NO: 770 - DNA, 20 bp, Artificial sequence
  Synthetic Oligonucleotide
agaagatgccactctccatg

SEQ ID NO: 771 - DNA, 20 bp, Artificial sequence
  Synthetic Oligonucleotide
caaagaagatgccactctcc

SEQ ID NO: 772 - DNA, 20 bp, Artificial sequence
  Synthetic Oligonucleotide
gatgcaaagaagatgccact

SEQ ID NO: 773 - DNA, 20 bp, Artificial sequence
  Synthetic Oligonucleotide
ggatgcaaagaagatgccac

SEQ ID NO: 774 - DNA, 20 bp, Artificial sequence
  Synthetic Oligonucleotide
taggatgcaaagaagatgcc

SEQ ID NO: 775 - DNA, 20 bp, Artificial sequence
  Synthetic Oligonucleotide
tccttaggatgcaaagaaga

SEQ ID NO: 776 - DNA, 20 bp, Artificial sequence
  Synthetic Oligonucleotide
cgtccttaggatgcaaagaa

SEQ ID NO: 777 - DNA, 20 bp, Artificial sequence
  Synthetic Oligonucleotide
attgtcctcagcagctctga

SEQ ID NO: 778 - DNA, 20 bp, Artificial sequence
  Synthetic Oligonucleotide
ccagacattgtcctcagcag

SEQ ID NO: 779 - DNA, 20 bp, Artificial sequence
  Synthetic Oligonucleotide
agccagacattgtcctcagc

SEQ ID NO: 780 - DNA, 20 bp, Artificial sequence
  Synthetic Oligonucleotide
tcagccagacattgtcctca

SEQ ID NO: 781 - DNA, 20 bp, Artificial sequence
  Synthetic Oligonucleotide
cttcagccagacattgtcct

SEQ ID NO: 782 - DNA, 20 bp, Artificial sequence
  Synthetic Oligonucleotide
agcgggcttcagccagacat

SEQ ID NO: 783 - DNA, 20 bp, Artificial sequence
  Synthetic Oligonucleotide
gaaagcgggcttcagccaga

SEQ ID NO: 784 - DNA, 20 bp, Artificial sequence
  Synthetic Oligonucleotide
ctgaaagcgggcttcagcca

SEQ ID NO: 785 - DNA, 20 bp, Artificial sequence
  Synthetic Oligonucleotide
cgtgctgaaagcgggcttca

SEQ ID NO: 786 - DNA, 20 bp, Artificial sequence
  Synthetic Oligonucleotide
gtcagcccctggttacggcg

SEQ ID NO: 787 - DNA, 20 bp, Artificial sequence
  Synthetic Oligonucleotide
ttgtcagcccctggttacgg

SEQ ID NO: 788 - DNA, 20 bp, Artificial sequence
  Synthetic Oligonucleotide
cattgtcagcccctggttac

SEQ ID NO: 789 - DNA, 20 bp, Artificial sequence
  Synthetic Oligonucleotide
gcattgtcagcccctggtta

SEQ ID NO: 790 - DNA, 20 bp, Artificial sequence
  Synthetic Oligonucleotide
cctcgcattgtcagcccctg

SEQ ID NO: 791 - DNA, 20 bp, Artificial sequence
  Synthetic Oligonucleotide
gacctcgcattgtcagcccc

SEQ ID NO: 792 - DNA, 20 bp, Artificial sequence
  Synthetic Oligonucleotide
gcgacctcgcattgtcagcc

SEQ ID NO: 793 - DNA, 20 bp, Artificial sequence
  Synthetic Oligonucleotide
ctcagttgcgacctcgcatt

SEQ ID NO: 794 - DNA, 20 bp, Artificial sequence
  Synthetic Oligonucleotide
tctcagttgcgacctcgcat

SEQ ID NO: 795 - DNA, 20 bp, Artificial sequence
  Synthetic Oligonucleotide
gtcatggagatctcagttgc

SEQ ID NO: 796 - DNA, 20 bp, Artificial sequence
  Synthetic Oligonucleotide
cacagtcatggagatctcag

SEQ ID NO: 797 - DNA, 20 bp, Artificial sequence
  Synthetic Oligonucleotide
ccatgaacatcctatccgtg

SEQ ID NO: 798 - DNA, 20 bp, Artificial sequence
  Synthetic Oligonucleotide
tgtcctgtcaacatattcca

SEQ ID NO: 799 - DNA, 20 bp, Artificial sequence
  Synthetic Oligonucleotide
gggtttctgccaacagtttc

SEQ ID NO: 800 - DNA, 20 bp, Artificial sequence
  Synthetic Oligonucleotide
gactttgggtttctgccaac

SEQ ID NO: 801 - DNA, 20 bp, Artificial sequence
  Synthetic Oligonucleotide
atattgactttgggtttctg

SEQ ID NO: 802 - DNA, 20 bp, Artificial sequence
  Synthetic Oligonucleotide
ggcttcaatattgactttgg

SEQ ID NO: 803 - DNA, 20 bp, Artificial sequence
  Synthetic Oligonucleotide
ctgcaggcaatattttgctt

SEQ ID NO: 804 - DNA, 20 bp, Artificial sequence
  Synthetic Oligonucleotide
atgtggcactgcaggcaata

SEQ ID NO: 805 - DNA, 20 bp, Artificial sequence
  Synthetic Oligonucleotide
ttctaatgtggcactgcagg

SEQ ID NO: 806 - DNA, 20 bp, Artificial sequence
  Synthetic Oligonucleotide
tcaagctgttctaatgtggc

SEQ ID NO: 807 - DNA, 20 bp, Artificial sequence
  Synthetic Oligonucleotide
acggtcttcaagctgttcta

SEQ ID NO: 808 - DNA, 20 bp, Artificial sequence
  Synthetic Oligonucleotide
ggtcaatctgactagtgaat

SEQ ID NO: 809 - DNA, 20 bp, Artificial sequence
  Synthetic Oligonucleotide
tctctggtcaatctgactag

SEQ ID NO: 810 - DNA, 20 bp, Artificial sequence
  Synthetic Oligonucleotide
gcccaccaacaatctctggt

SEQ ID NO: 811 - DNA, 20 bp, Artificial sequence
  Synthetic Oligonucleotide
gaccccaacagacagcccac

SEQ ID NO: 812 - DNA, 20 bp, Artificial sequence
  Synthetic Oligonucleotide
ccagaatcatgccttgtggg

SEQ ID NO: 813 - DNA, 20 bp, Artificial sequence
  Synthetic Oligonucleotide
gtcaccatagacccagaatc

SEQ ID NO: 814 - DNA, 20 bp, Artificial sequence
  Synthetic Oligonucleotide
gtggccctcttaagtcacca

SEQ ID NO: 815 - DNA, 20 bp, Artificial sequence
  Synthetic Oligonucleotide
ctcattgttgtgtggccctc

SEQ ID NO: 816 - DNA, 20 bp, Artificial sequence
  Synthetic Oligonucleotide
gtagccatacatctgaggaa

SEQ ID NO: 817 - DNA, 20 bp, Artificial sequence
  Synthetic Oligonucleotide
atgtttattgtagccataca

SEQ ID NO: 818 - DNA, 20 bp, Artificial sequence
  Synthetic Oligonucleotide
ctcgcctttgtgactcgatt

SEQ ID NO: 819 - DNA, 20 bp, Artificial sequence
  Synthetic Oligonucleotide
catactcgcctttgtgactc

SEQ ID NO: 820 - DNA, 20 bp, Artificial sequence
  Synthetic Oligonucleotide
gcatactcgcctttgtgact

SEQ ID NO: 821 - DNA, 20 bp, Artificial sequence
  Synthetic Oligonucleotide
tgcatactcgcctttgtgac

SEQ ID NO: 822 - DNA, 20 bp, Artificial sequence
  Synthetic Oligonucleotide
ttcacaacacacagtcatgg

SEQ ID NO: 823 - DNA, 20 bp, Artificial sequence
  Synthetic Oligonucleotide
ttttttgatctttcaccatt

SEQ ID NO: 824 - DNA, 20 bp, Artificial sequence
  Synthetic Oligonucleotide
atgcatactcgcctttgtga

SEQ ID NO: 825 - DNA, 20 bp, Artificial sequence
  Synthetic Oligonucleotide
catgcatactcgcctttgtg

SEQ ID NO: 826 - DNA, 20 bp, Artificial sequence
  Synthetic Oligonucleotide
ccatgcatactcgcctttgt

SEQ ID NO: 827 - DNA, 20 bp, Artificial sequence
  Synthetic Oligonucleotide
acacacagtcatggagatct

SEQ ID NO: 828 - DNA, 20 bp, Artificial sequence
  Synthetic Oligonucleotide
acaacacacagtcatggaga

SEQ ID NO: 829 - DNA, 20 bp, Artificial sequence
  Synthetic Oligonucleotide
ttatttcacaacacacagtc

SEQ ID NO: 830 - DNA, 20 bp, Artificial sequence
  Synthetic Oligonucleotide
tccatgcatactcgcctttg

SEQ ID NO: 831 - DNA, 20 bp, Artificial sequence
  Synthetic Oligonucleotide
ttccatgcatactcgccttt

SEQ ID NO: 832 - DNA, 20 bp, Artificial sequence
  Synthetic Oligonucleotide
tttccatgcatactcgcctt

SEQ ID NO: 833 - DNA, 20 bp, Artificial sequence
  Synthetic Oligonucleotide
gattttccatgcatactcgc

SEQ ID NO: 834 - DNA, 20 bp, Artificial sequence
  Synthetic Oligonucleotide
gtgatgcgattttccatgca

SEQ ID NO: 835 - DNA, 20 bp, Artificial sequence
  Synthetic Oligonucleotide
gcagcaagtgctccccatgc

SEQ ID NO: 836 - DNA, 20 bp, Artificial sequence
  Synthetic Oligonucleotide
gtgatgaaagtacagcagca

SEQ ID NO: 837 - DNA, 20 bp, Artificial sequence
  Synthetic Oligonucleotide
tcctatccgtgttcagctgt

SEQ ID NO: 838 - DNA, 20 bp, Artificial sequence
  Synthetic Oligonucleotide
tactctctacatactcagga

SEQ ID NO: 839 - DNA, 20 bp, Artificial sequence
  Synthetic Oligonucleotide
tgagacctccagactactgt

SEQ ID NO: 840 - DNA, 20 bp, Artificial sequence
  Synthetic Oligonucleotide
ctctgctggttttagaccac

SEQ ID NO: 841 - DNA, 20 bp, Artificial sequence
  Synthetic Oligonucleotide
gggacaatctccacccccga

SEQ ID NO: 842 - DNA, 20 bp, Artificial sequence
  Synthetic Oligonucleotide
tgcagagtgtcatctgcgaa

SEQ ID NO: 843 - DNA, 20 bp, Artificial sequence
  Synthetic Oligonucleotide
tggttccctagcggtccaga

SEQ ID NO: 844 - DNA, 20 bp, Artificial sequence
  Synthetic Oligonucleotide
cccctgtagttggctgtggt

SEQ ID NO: 845 - DNA, 20 bp, Artificial sequence
  Synthetic Oligonucleotide
gcaagtcaaagagtgtccac

SEQ ID NO: 846 - DNA, 20 bp, Artificial sequence
  Synthetic Oligonucleotide
gaagcctgttagagttggcc

SEQ ID NO: 847 - DNA, 20 bp, Artificial sequence
  Synthetic Oligonucleotide
cccccatgtccatggacttt

SEQ ID NO: 848 - DNA, 20 bp, Artificial sequence
  Synthetic Oligonucleotide
ctgccaacagtttcaacttt

SEQ ID NO: 849 - DNA, 20 bp, Artificial sequence
  Synthetic Oligonucleotide
ttttgcttggcttcaatatt

SEQ ID NO: 850 - DNA, 20 bp, Artificial sequence
  Synthetic Oligonucleotide
atctgactagtgaatggctt

SEQ ID NO: 851 - DNA, 20 bp, Artificial sequence
  Synthetic Oligonucleotide
agacagcccaccaacaatct

SEQ ID NO: 852 - DNA, 20 bp, Artificial sequence
  Synthetic Oligonucleotide
tgcatagaccccaacagaca

SEQ ID NO: 853 - DNA, 20 bp, Artificial sequence
  Synthetic Oligonucleotide
cctgtgcatagaccccaaca

SEQ ID NO: 854 - DNA, 20 bp, Artificial sequence
  Synthetic Oligonucleotide
ccagcagaaatcctgtgcat

SEQ ID NO: 855 - DNA, 20 bp, Artificial sequence
  Synthetic Oligonucleotide
agaactccagcagaaatcct

SEQ ID NO: 856 - DNA, 20 bp, Artificial sequence
  Synthetic Oligonucleotide
ttgtgtggccctcttaagtc

SEQ ID NO: 857 - DNA, 20 bp, Artificial sequence
  Synthetic Oligonucleotide
tatagatgtttattgtagcc

SEQ ID NO: 858 - DNA, 20 bp, Artificial sequence
  Synthetic Oligonucleotide
atactcgcctttgtgactcg

SEQ ID NO: 859 - DNA, 20 bp, Artificial sequence
  Synthetic Oligonucleotide
ttttccatgcatactcgcct

SEQ ID NO: 860 - DNA, 20 bp, Artificial sequence
  Synthetic Oligonucleotide
tcgcctttgtgatgcgattt

SEQ ID NO: 861 - DNA, 20 bp, Artificial sequence
  Synthetic Oligonucleotide
atactcgcctttgtgatgcg

SEQ ID NO: 862 - DNA, 20 bp, Artificial sequence
  Synthetic Oligonucleotide
catactcgcctttgtgatgc

SEQ ID NO: 863 - DNA, 20 bp, Artificial sequence
  Synthetic Oligonucleotide
gcatactcgcctttgtgatg

SEQ ID NO: 864 - DNA, 20 bp, Artificial sequence
  Synthetic Oligonucleotide
tgcatactcgcctttgtgat

SEQ ID NO: 865 - DNA, 20 bp, Artificial sequence
  Synthetic Oligonucleotide
cccatgcatactcgcctttg

SEQ ID NO: 866 - DNA, 20 bp, Artificial sequence
  Synthetic Oligonucleotide
ccccatgcatactcgccttt

SEQ ID NO: 867 - DNA, 20 bp, Artificial sequence
  Synthetic Oligonucleotide
tccccatgcatactcgcctt

SEQ ID NO: 868 - DNA, 20 bp, Artificial sequence
  Synthetic Oligonucleotide
ctccccatgcatactcgcct

SEQ ID NO: 869 - DNA, 20 bp, Artificial sequence
  Synthetic Oligonucleotide
tgctccccatgcatactcgc

SEQ ID NO: 870 - DNA, 20 bp, Artificial sequence
  Synthetic Oligonucleotide
gctctgattgggtcaccaca

SEQ ID NO: 871 - DNA, 20 bp, Artificial sequence
  Synthetic Oligonucleotide
tgtctccttccacttgctcc

SEQ ID NO: 872 - DNA, 20 bp, Artificial sequence
  Synthetic Oligonucleotide
gccattttatccctgagatt

SEQ ID NO: 873 - DNA, 20 bp, Artificial sequence
  Synthetic Oligonucleotide
ctgtgctgtattttggagcc

SEQ ID NO: 874 - DNA, 20 bp, Artificial sequence
  Synthetic Oligonucleotide
ggatttggccctgagcccca

SEQ ID NO: 875 - DNA, 20 bp, Artificial sequence
  Synthetic Oligonucleotide
caacctgtccattccctggg

SEQ ID NO: 876 - DNA, 20 bp, Artificial sequence
  Synthetic Oligonucleotide
attcggtgtctttactggct

SEQ ID NO: 877 - DNA, 20 bp, Artificial sequence
  Synthetic Oligonucleotide
tcctgttgcctgacatgcta

SEQ ID NO: 878 - DNA, 20 bp, Artificial sequence
  Synthetic Oligonucleotide
ctcccactgactgactactc

SEQ ID NO: 879 - DNA, 20 bp, Artificial sequence
  Synthetic Oligonucleotide
gctggtccttgaaccccgtg

SEQ ID NO: 880 - DNA, 20 bp, Artificial sequence
  Synthetic Oligonucleotide
ctggctcactataggcccca

SEQ ID NO: 881 - DNA, 20 bp, Artificial sequence
  Synthetic Oligonucleotide
ataagcatctctctgaccta

SEQ ID NO: 882 - DNA, 20 bp, Artificial sequence
  Synthetic Oligonucleotide
gcttccccaatacttgctgg

SEQ ID NO: 883 - DNA, 20 bp, Artificial sequence
  Synthetic Oligonucleotide
gtgtccagaatactgcccca

SEQ ID NO: 884 - DNA, 20 bp, Artificial sequence
  Synthetic Oligonucleotide
gtggacgactgccctgtgcc

SEQ ID NO: 885 - DNA, 20 bp, Artificial sequence
  Synthetic Oligonucleotide
tctctagcatcctagtcctc

SEQ ID NO: 886 - DNA, 20 bp, Artificial sequence
  Synthetic Oligonucleotide
atactggctaagtcaggccc

SEQ ID NO: 887 - DNA, 20 bp, Artificial sequence
  Synthetic Oligonucleotide
ggcagggaggtggattattc

SEQ ID NO: 888 - DNA, 20 bp, Artificial sequence
  Synthetic Oligonucleotide
gcttctctatctcccagtgt

SEQ ID NO: 889 - DNA, 20 bp, Artificial sequence
  Synthetic Oligonucleotide
gatgcatgcagcaatacagg

SEQ ID NO: 890 - DNA, 20 bp, Artificial sequence
  Synthetic Oligonucleotide
gtctcgatggcaagctgtac

SEQ ID NO: 891 - DNA, 20 bp, Artificial sequence
  Synthetic Oligonucleotide
gtactcaccggtactctgcc

SEQ ID NO: 892 - DNA, 20 bp, Artificial sequence
  Synthetic Oligonucleotide
atgaagggcgaggcgcagtg

SEQ ID NO: 893 - DNA, 20 bp, Artificial sequence
  Synthetic Oligonucleotide
ccccatacatctatgcaaat

SEQ ID NO: 894 - DNA, 20 bp, Artificial sequence
  Synthetic Oligonucleotide
acatgactccagtgatggat

SEQ ID NO: 895 - DNA, 20 bp, Artificial sequence
  Synthetic Oligonucleotide
aaaatgacaccaaaattcgc

SEQ ID NO: 896 - DNA, 20 bp, Artificial sequence
  Synthetic Oligonucleotide
tggacatccttcccctcgca

SEQ ID NO: 897 - DNA, 20 bp, Artificial sequence
  Synthetic Oligonucleotide
gctctgagccttccgcctct

SEQ ID NO: 898 - DNA, 20 bp, Artificial sequence
  Synthetic Oligonucleotide
actagtttcctataactgct

SEQ ID NO: 899 - DNA, 20 bp, Artificial sequence
  Synthetic Oligonucleotide
tactagtttcctataactgc

SEQ ID NO: 900 - DNA, 20 bp, Artificial sequence
  Synthetic Oligonucleotide
gtactagtttcctataactg

SEQ ID NO: 901 - DNA, 20 bp, Artificial sequence
  Synthetic Oligonucleotide
gtatcactgtactagtttcc

SEQ ID NO: 902 - DNA, 20 bp, Artificial sequence
  Synthetic Oligonucleotide
agtatcactgtactagtttc

SEQ ID NO: 903 - DNA, 20 bp, Artificial sequence
  Synthetic Oligonucleotide
cagtatcactgtactagttt

SEQ ID NO: 904 - DNA, 20 bp, Artificial sequence
  Synthetic Oligonucleotide
acagtatcactgtactagtt

SEQ ID NO: 905 - DNA, 20 bp, Artificial sequence
  Synthetic Oligonucleotide
aacagtatcactgtactagt

SEQ ID NO: 906 - DNA, 20 bp, Artificial sequence
  Synthetic Oligonucleotide
taacagtatcactgtactag

SEQ ID NO: 907 - DNA, 20 bp, Artificial sequence
  Synthetic Oligonucleotide
tctaacagtatcactgtact

SEQ ID NO: 908 - DNA, 20 bp, Artificial sequence
  Synthetic Oligonucleotide
ctctaacagtatcactgtac

SEQ ID NO: 909 - DNA, 20 bp, Artificial sequence
  Synthetic Oligonucleotide
actctaacagtatcactgta

SEQ ID NO: 910 - DNA, 20 bp, Artificial sequence
  Synthetic Oligonucleotide
aactctaacagtatcactgt

SEQ ID NO: 911 - DNA, 20 bp, Artificial sequence
  Synthetic Oligonucleotide
taactctaacagtatcactg

SEQ ID NO: 912 - DNA, 20 bp, Artificial sequence
  Synthetic Oligonucleotide
ataactctaacagtatcact

SEQ ID NO: 913 - DNA, 20 bp, Artificial sequence
  Synthetic Oligonucleotide
tataactctaacagtatcac

SEQ ID NO: 914 - DNA, 20 bp, Artificial sequence
  Synthetic Oligonucleotide
ctataactctaacagtatca

SEQ ID NO: 915 - DNA, 20 bp, Artificial sequence
  Synthetic Oligonucleotide
cctataactctaacagtatc

SEQ ID NO: 916 - DNA, 20 bp, Artificial sequence
  Synthetic Oligonucleotide
ctgtcctataactctaacag

SEQ ID NO: 917 - DNA, 20 bp, Artificial sequence
  Synthetic Oligonucleotide
cactgtcctataactctaac

SEQ ID NO: 918 - DNA, 20 bp, Artificial sequence
  Synthetic Oligonucleotide
tcactgtcctataactctaa

SEQ ID NO: 919 - DNA, 20 bp, Artificial sequence
  Synthetic Oligonucleotide
tatcactgtcctataactct

SEQ ID NO: 920 - DNA, 20 bp, Artificial sequence
  Synthetic Oligonucleotide
gtcctatatcactgtcctat

SEQ ID NO: 921 - DNA, 20 bp, Artificial sequence
  Synthetic Oligonucleotide
tgtcctatatcactgtccta

SEQ ID NO: 922 - DNA, 20 bp, Artificial sequence
  Synthetic Oligonucleotide
ctgtcctatatcactgtcct

SEQ ID NO: 923 - DNA, 20 bp, Artificial sequence
  Synthetic Oligonucleotide
actgtcctatatcactgtcc

SEQ ID NO: 924 - DNA, 20 bp, Artificial sequence
  Synthetic Oligonucleotide
tcactgtcctatatcactgt

SEQ ID NO: 925 - DNA, 20 bp, Artificial sequence
  Synthetic Oligonucleotide
cccccagttcccatgcaagg

SEQ ID NO: 926 - DNA, 20 bp, Artificial sequence
  Synthetic Oligonucleotide
gagcacagatctcttcaagt

SEQ ID NO: 927 - DNA, 20 bp, Artificial sequence
  Synthetic Oligonucleotide
gacggtcacccagccctgac

SEQ ID NO: 928 - DNA, 20 bp, Artificial sequence
  Synthetic Oligonucleotide
aagggaaattagaggcaggc

SEQ ID NO: 929 - DNA, 20 bp, Artificial sequence
  Synthetic Oligonucleotide
ctttcttgagacaatccctt

SEQ ID NO: 930 - DNA, 20 bp, Artificial sequence
  Synthetic Oligonucleotide
gtgggatcagagaatgacta

SEQ ID NO: 931 - DNA, 20 bp, Artificial sequence
  Synthetic Oligonucleotide
ccctctgtcttagatgtcca

SEQ ID NO: 932 - DNA, 20 bp, Artificial sequence
  Synthetic Oligonucleotide
cttatcagtcccagtcatgt

SEQ ID NO: 933 - DNA, 20 bp, Artificial sequence
  Synthetic Oligonucleotide
aagagttgggatgcgactct

SEQ ID NO: 934 - DNA, 20 bp, Artificial sequence
  Synthetic Oligonucleotide
tccactcctaagaagtatgg

SEQ ID NO: 935 - DNA, 20 bp, Artificial sequence
  Synthetic Oligonucleotide
gcacccttttcattgagatt

SEQ ID NO: 936 - DNA, 20 bp, Artificial sequence
  Synthetic Oligonucleotide
actaccatttgggttggtag

SEQ ID NO: 937 - DNA, 20 bp, Artificial sequence
  Synthetic Oligonucleotide
aagccctgtttggtttttag

SEQ ID NO: 938 - DNA, 20 bp, Artificial sequence
  Synthetic Oligonucleotide
aaatgacaccaaaattgagt

SEQ ID NO: 939 - DNA, 20 bp, Artificial sequence
  Synthetic Oligonucleotide
aaatgacaccaaaattcgct

SEQ ID NO: 940 - DNA, 20 bp, Artificial sequence
  Synthetic Oligonucleotide
taagcaaggcctatgtgtgg

SEQ ID NO: 941 - DNA, 20 bp, Artificial sequence
  Synthetic Oligonucleotide
acacgcacaggtcccagggc

SEQ ID NO: 942 - DNA, 20 bp, Artificial sequence
  Synthetic Oligonucleotide
gggaaactctttcctcgccc

SEQ ID NO: 943 - DNA, 20 bp, Artificial sequence
  Synthetic Oligonucleotide
ctagtttcctataactgctg

SEQ ID NO: 944 - DNA, 20 bp, Artificial sequence
  Synthetic Oligonucleotide
ctaacagtatcactgtacta

SEQ ID NO: 945 - DNA, 20 bp, Artificial sequence
  Synthetic Oligonucleotide
gtcctataactctaacagta

SEQ ID NO: 946 - DNA, 20 bp, Artificial sequence
  Synthetic Oligonucleotide
tgtcctataactctaacagt

SEQ ID NO: 947 - DNA, 20 bp, Artificial sequence
  Synthetic Oligonucleotide
atcactgtcctataactcta

SEQ ID NO: 948 - DNA, 20 bp, Artificial sequence
  Synthetic Oligonucleotide
atatcactgtcctataactc

SEQ ID NO: 949 - DNA, 20 bp, Artificial sequence
  Synthetic Oligonucleotide
tatatcactgtcctataact

SEQ ID NO: 950 - DNA, 20 bp, Artificial sequence
  Synthetic Oligonucleotide
cactgtcctatatcactgtc

SEQ ID NO: 951 - DNA, 20 bp, Artificial sequence
  Synthetic Oligonucleotide
atcactgtcctatatcactg

SEQ ID NO: 952 - DNA, 20 bp, Artificial sequence
  Synthetic Oligonucleotide
tatcactgtcctatatcact

SEQ ID NO: 953 - DNA, 20 bp, Artificial sequence
  Synthetic Oligonucleotide
agtatcactgtcctatatca

SEQ ID NO: 954 - DNA, 20 bp, Artificial sequence
  Synthetic Oligonucleotide
cagtatcactgtcctatatc

SEQ ID NO: 955 - DNA, 20 bp, Artificial sequence
  Synthetic Oligonucleotide
acagtatcactgtcctatat

SEQ ID NO: 956 - DNA, 20 bp, Artificial sequence
  Synthetic Oligonucleotide
taacagtatcactgtcctat

SEQ ID NO: 957 - DNA, 20 bp, Artificial sequence
  Synthetic Oligonucleotide
ataacagtatcactgtccta

SEQ ID NO: 958 - DNA, 20 bp, Artificial sequence
  Synthetic Oligonucleotide
aactataacagtatcactgt

SEQ ID NO: 959 - DNA, 20 bp, Artificial sequence
  Synthetic Oligonucleotide
tataactataacagtatcac

SEQ ID NO: 960 - DNA, 20 bp, Artificial sequence
  Synthetic Oligonucleotide
ctataactataacagtatca

SEQ ID NO: 961 - DNA, 20 bp, Artificial sequence
  Synthetic Oligonucleotide
tttcctataactataacagt

SEQ ID NO: 962 - DNA, 20 bp, Artificial sequence
  Synthetic Oligonucleotide
ctagtttcctataactataa

SEQ ID NO: 963 - DNA, 20 bp, Artificial sequence
  Synthetic Oligonucleotide
taacaatatcactgtcctat

SEQ ID NO: 964 - DNA, 20 bp, Artificial sequence
  Synthetic Oligonucleotide
aactataacaatatcactgt

SEQ ID NO: 965 - DNA, 20 bp, Artificial sequence
  Synthetic Oligonucleotide
taactataacaatatcactg

SEQ ID NO: 966 - DNA, 20 bp, Artificial sequence
  Synthetic Oligonucleotide
ataactataacaatatcact

SEQ ID NO: 967 - DNA, 20 bp, Artificial sequence
  Synthetic Oligonucleotide
tataactataacaatatcac

SEQ ID NO: 968 - DNA, 20 bp, Artificial sequence
  Synthetic Oligonucleotide
gtttcctataactataacaa

SEQ ID NO: 969 - DNA, 20 bp, Artificial sequence
  Synthetic Oligonucleotide
acctataactctaacagtat

SEQ ID NO: 970 - DNA, 20 bp, Artificial sequence
  Synthetic Oligonucleotide
tacctataactctaacagta

SEQ ID NO: 971 - DNA, 20 bp, Artificial sequence
  Synthetic Oligonucleotide
tgtacctataactctaacag

SEQ ID NO: 972 - DNA, 20 bp, Artificial sequence
  Synthetic Oligonucleotide
ctgtacctataactctaaca

SEQ ID NO: 973 - DNA, 20 bp, Artificial sequence
  Synthetic Oligonucleotide
actgtacctataactctaac

SEQ ID NO: 974 - DNA, 20 bp, Artificial sequence
  Synthetic Oligonucleotide
cactgtacctataactctaa

SEQ ID NO: 975 - DNA, 20 bp, Artificial sequence
  Synthetic Oligonucleotide
caatatcactgtacctataa

SEQ ID NO: 976 - DNA, 20 bp, Artificial sequence
  Synthetic Oligonucleotide
ataacaatatcactgtacct

SEQ ID NO: 977 - DNA, 20 bp, Artificial sequence
  Synthetic Oligonucleotide
actataacaatatcactgta

SEQ ID NO: 978 - DNA, 20 bp, Artificial sequence
  Synthetic Oligonucleotide
gtcctatatcactgtacctg

SEQ ID NO: 979 - DNA, 20 bp, Artificial sequence
  Synthetic Oligonucleotide
cactgtcctatatcactgta

SEQ ID NO: 980 - DNA, 20 bp, Artificial sequence
  Synthetic Oligonucleotide
cctataacagtatcactgtc

SEQ ID NO: 981 - DNA, 20 bp, Artificial sequence
  Synthetic Oligonucleotide
tttcctataacagtatcact

SEQ ID NO: 982 - DNA, 20 bp, Artificial sequence
  Synthetic Oligonucleotide
gtttcctataacagtatcac

SEQ ID NO: 983 - DNA, 20 bp, Artificial sequence
  Synthetic Oligonucleotide
agtttcctataacagtatca

SEQ ID NO: 984 - DNA, 20 bp, Artificial sequence
  Synthetic Oligonucleotide
tagtttcctataacagtatc

SEQ ID NO: 985 - DNA, 20 bp, Artificial sequence
  Synthetic Oligonucleotide
ctagtttcctataacagtat

SEQ ID NO: 986 - DNA, 20 bp, Artificial sequence
  Synthetic Oligonucleotide
actagtttcctataacagta

SEQ ID NO: 987 - DNA, 20 bp, Artificial sequence
  Synthetic Oligonucleotide
gtatcactgtcctatatcac

SEQ ID NO: 988 - DNA, 20 bp, Artificial sequence
  Synthetic Oligonucleotide
aacagtatcactgtcctata

SEQ ID NO: 989 - DNA, 20 bp, Artificial sequence
  Synthetic Oligonucleotide
tataacagtatcactgtcct

SEQ ID NO: 990 - DNA, 20 bp, Artificial sequence
  Synthetic Oligonucleotide
ctataacagtatcactgtcc

SEQ ID NO: 991 - DNA, 20 bp, Artificial sequence
  Synthetic Oligonucleotide
actataacagtatcactgtc

SEQ ID NO: 992 - DNA, 20 bp, Artificial sequence
  Synthetic Oligonucleotide
taactataacagtatcactg

SEQ ID NO: 993 - DNA, 20 bp, Artificial sequence
  Synthetic Oligonucleotide
ataactataacagtatcact

SEQ ID NO: 994 - DNA, 20 bp, Artificial sequence
  Synthetic Oligonucleotide
cctataactataacagtatc

SEQ ID NO: 995 - DNA, 20 bp, Artificial sequence
  Synthetic Oligonucleotide
tcctataactataacagtat

SEQ ID NO: 996 - DNA, 20 bp, Artificial sequence
  Synthetic Oligonucleotide
ttcctataactataacagta

SEQ ID NO: 997 - DNA, 20 bp, Artificial sequence
  Synthetic Oligonucleotide
gtttcctataactataacag

SEQ ID NO: 998 - DNA, 20 bp, Artificial sequence
  Synthetic Oligonucleotide
actagtttcctataactata

SEQ ID NO: 999 - DNA, 20 bp, Artificial sequence
  Synthetic Oligonucleotide
tactagtttcctataactat

SEQ ID NO: 1000 - DNA, 20 bp, Artificial sequence
  Synthetic Oligonucleotide
caatatcactgtcctatatc

SEQ ID NO: 1001 - DNA, 20 bp, Artificial sequence
  Synthetic Oligonucleotide
actataacaatatcactgtc

SEQ ID NO: 1002 - DNA, 20 bp, Artificial sequence
  Synthetic Oligonucleotide
ttcctataactataacaata

SEQ ID NO: 1003 - DNA, 20 bp, Artificial sequence
  Synthetic Oligonucleotide
tttcctataactataacaat

SEQ ID NO: 1004 - DNA, 20 bp, Artificial sequence
  Synthetic Oligonucleotide
gtacctataactctaacagt

SEQ ID NO: 1005 - DNA, 20 bp, Artificial sequence
  Synthetic Oligonucleotide
tcactgtacctataactcta

SEQ ID NO: 1006 - DNA, 20 bp, Artificial sequence
  Synthetic Oligonucleotide
tatcactgtacctataactc

SEQ ID NO: 1007 - DNA, 20 bp, Artificial sequence
  Synthetic Oligonucleotide
atatcactgtacctataact

SEQ ID NO: 1008 - DNA, 20 bp, Artificial sequence
  Synthetic Oligonucleotide
acaatatcactgtacctata

SEQ ID NO: 1009 - DNA, 20 bp, Artificial sequence
  Synthetic Oligonucleotide
aacaatatcactgtacctat

SEQ ID NO: 1010 - DNA, 20 bp, Artificial sequence
  Synthetic Oligonucleotide
taacaatatcactgtaccta

SEQ ID NO: 1011 - DNA, 20 bp, Artificial sequence
  Synthetic Oligonucleotide
tataacaatatcactgtacc

SEQ ID NO: 1012 - DNA, 20 bp, Artificial sequence
  Synthetic Oligonucleotide
ctataacaatatcactgtac

SEQ ID NO: 1013 - DNA, 20 bp, Artificial sequence
  Synthetic Oligonucleotide
tgtaacagtatcactgtact

SEQ ID NO: 1014 - DNA, 20 bp, Artificial sequence
  Synthetic Oligonucleotide
ctgtaacagtatcactgtac

SEQ ID NO: 1015 - DNA, 20 bp, Artificial sequence
  Synthetic Oligonucleotide
cctgtaacagtatcactgta

SEQ ID NO: 1016 - DNA, 20 bp, Artificial sequence
  Synthetic Oligonucleotide
ctatatcactgtacctgtaa

SEQ ID NO: 1017 - DNA, 20 bp, Artificial sequence
  Synthetic Oligonucleotide
cctatatcactgtacctgta

SEQ ID NO: 1018 - DNA, 20 bp, Artificial sequence
  Synthetic Oligonucleotide
tcctatatcactgtacctgt

SEQ ID NO: 1019 - DNA, 20 bp, Artificial sequence
  Synthetic Oligonucleotide
tgtcctatatcactgtacct

SEQ ID NO: 1020 - DNA, 20 bp, Artificial sequence
  Synthetic Oligonucleotide
ctgtcctatatcactgtacc

SEQ ID NO: 1021 - DNA, 20 bp, Artificial sequence
  Synthetic Oligonucleotide
actgtcctatatcactgtac

SEQ ID NO: 1022 - DNA, 20 bp, Artificial sequence
  Synthetic Oligonucleotide
tcctataacagtatcactgt

SEQ ID NO: 1023 - DNA, 20 bp, Artificial sequence
  Synthetic Oligonucleotide
ttcctataacagtatcactg

SEQ ID NO: 1024 - DNA, 20 bp, Artificial sequence
  Synthetic Oligonucleotide
tactagtttcctataacagt

SEQ ID NO: 1025 - DNA, 20 bp, Artificial sequence
  Synthetic Oligonucleotide
gtcactgtacctataactct

SEQ ID NO: 1026 - DNA, 20 bp, Artificial sequence
  Synthetic Oligonucleotide
tgtcactgtacctataactc

SEQ ID NO: 1027 - DNA, 20 bp, Artificial sequence
  Synthetic Oligonucleotide
atgtcactgtacctataact

SEQ ID NO: 1028 - DNA, 20 bp, Artificial sequence
  Synthetic Oligonucleotide
tatgtcactgtacctataac

SEQ ID NO: 1029 - DNA, 20 bp, Artificial sequence
  Synthetic Oligonucleotide
ctatgtcactgtacctataa

SEQ ID NO: 1030 - DNA, 20 bp, Artificial sequence
  Synthetic Oligonucleotide
cctatgtcactgtacctata

SEQ ID NO: 1031 - DNA, 20 bp, Artificial sequence
  Synthetic Oligonucleotide
tcctatgtcactgtacctat

SEQ ID NO: 1032 - DNA, 20 bp, Artificial sequence
  Synthetic Oligonucleotide
gtcctatgtcactgtaccta

SEQ ID NO: 1033 - DNA, 20 bp, Artificial sequence
  Synthetic Oligonucleotide
tgtcctatgtcactgtacct

SEQ ID NO: 1034 - DNA, 20 bp, Artificial sequence
  Synthetic Oligonucleotide
ctgtcctatgtcactgtacc

SEQ ID NO: 1035 - DNA, 20 bp, Artificial sequence
  Synthetic Oligonucleotide
actgtcctatgtcactgtac

SEQ ID NO: 1036 - DNA, 20 bp, Artificial sequence
  Synthetic Oligonucleotide
cactgtcctatgtcactgta

SEQ ID NO: 1037 - DNA, 20 bp, Artificial sequence
  Synthetic Oligonucleotide
tcactgtcctatgtcactgt

SEQ ID NO: 1038 - DNA, 20 bp, Artificial sequence
  Synthetic Oligonucleotide
tatcactgtcctatgtcact

SEQ ID NO: 1039 - DNA, 20 bp, Artificial sequence
  Synthetic Oligonucleotide
gtatcactgtcctatgtcac

SEQ ID NO: 1040 - DNA, 20 bp, Artificial sequence
  Synthetic Oligonucleotide
agtatcactgtcctatgtca

SEQ ID NO: 1041 - DNA, 20 bp, Artificial sequence
  Synthetic Oligonucleotide
aacagtatcactgtcctatg

SEQ ID NO: 1042 - DNA, 20 bp, Artificial sequence
  Synthetic Oligonucleotide
ctacctataactctaacagt

SEQ ID NO: 1043 - DNA, 20 bp, Artificial sequence
  Synthetic Oligonucleotide
actgtcctataactataaca

SEQ ID NO: 1044 - DNA, 20 bp, Artificial sequence
  Synthetic Oligonucleotide
cactgtcctataactataac

SEQ ID NO: 1045 - DNA, 20 bp, Artificial sequence
  Synthetic Oligonucleotide
cctatatcactgtacctata

SEQ ID NO: 1046 - DNA, 20 bp, Artificial sequence
  Synthetic Oligonucleotide
tcctatatcactgtacctat

SEQ ID NO: 1047 - DNA, 20 bp, Artificial sequence
  Synthetic Oligonucleotide
tacctataacagtatcactg

SEQ ID NO: 1048 - DNA, 20 bp, Artificial sequence
  Synthetic Oligonucleotide
ataactataacagtatcacc

SEQ ID NO: 1049 - DNA, 20 bp, Artificial sequence
  Synthetic Oligonucleotide
tcactgtacctataactata

SEQ ID NO: 1050 - DNA, 20 bp, Artificial sequence
  Synthetic Oligonucleotide
aacaatatcactgtaccttt

SEQ ID NO: 1051 - DNA, 20 bp, Artificial sequence
  Synthetic Oligonucleotide
taacaatatcactgtacctt

SEQ ID NO: 1052 - DNA, 20 bp, Artificial sequence
  Synthetic Oligonucleotide
gtcctataactataacaata

SEQ ID NO: 1053 - DNA, 20 bp, Artificial sequence
  Synthetic Oligonucleotide
cagtatcactgtcctatgtc

SEQ ID NO: 1054 - DNA, 20 bp, Artificial sequence
  Synthetic Oligonucleotide
acagtatcactgtcctatgt

SEQ ID NO: 1055 - DNA, 20 bp, Artificial sequence
  Synthetic Oligonucleotide
tctacctataactctaacag

SEQ ID NO: 1056 - DNA, 20 bp, Artificial sequence
  Synthetic Oligonucleotide
ctctacctataactctaaca

SEQ ID NO: 1057 - DNA, 20 bp, Artificial sequence
  Synthetic Oligonucleotide
actctacctataactctaac

SEQ ID NO: 1058 - DNA, 20 bp, Artificial sequence
  Synthetic Oligonucleotide
actgtcctatatcactctac

SEQ ID NO: 1059 - DNA, 20 bp, Artificial sequence
  Synthetic Oligonucleotide
cactgtcctatatcactcta

SEQ ID NO: 1060 - DNA, 20 bp, Artificial sequence
  Synthetic Oligonucleotide
tcactgtcctatatcactct

SEQ ID NO: 1061 - DNA, 20 bp, Artificial sequence
  Synthetic Oligonucleotide
atcactgtcctatatcactc

SEQ ID NO: 1062 - DNA, 20 bp, Artificial sequence
  Synthetic Oligonucleotide
atcactgtactagttttcta

SEQ ID NO: 1063 - DNA, 20 bp, Artificial sequence
  Synthetic Oligonucleotide
tatcactgtactagttttct

SEQ ID NO: 1064 - DNA, 20 bp, Artificial sequence
  Synthetic Oligonucleotide
gtatcactgtactagttttc

SEQ ID NO: 1065 - DNA, 20 bp, Artificial sequence
  Synthetic Oligonucleotide
agtatcactgtactagtttt

SEQ ID NO: 1066 - DNA, 20 bp, Artificial sequence
  Synthetic Oligonucleotide
ataacagtatcactgtacta

SEQ ID NO: 1067 - DNA, 20 bp, Artificial sequence
  Synthetic Oligonucleotide
gtcctataactataacagta

SEQ ID NO: 1068 - DNA, 20 bp, Artificial sequence
  Synthetic Oligonucleotide
tgtcctataactataacagt

SEQ ID NO: 1069 - DNA, 20 bp, Artificial sequence
  Synthetic Oligonucleotide
ctgtcctataactataacag

SEQ ID NO: 1070 - DNA, 20 bp, Artificial sequence
  Synthetic Oligonucleotide
tcactgtcctataactataa

SEQ ID NO: 1071 - DNA, 20 bp, Artificial sequence
  Synthetic Oligonucleotide
atcactgtcctataactata

SEQ ID NO: 1072 - DNA, 20 bp, Artificial sequence
  Synthetic Oligonucleotide
tatcactgtcctataactat

SEQ ID NO: 1073 - DNA, 20 bp, Artificial sequence
  Synthetic Oligonucleotide
atatcactgtcctataacta

SEQ ID NO: 1074 - DNA, 20 bp, Artificial sequence
  Synthetic Oligonucleotide
ctatatcactgtacctataa

SEQ ID NO: 1075 - DNA, 20 bp, Artificial sequence
  Synthetic Oligonucleotide
gtcctatatcactgtaccta

SEQ ID NO: 1076 - DNA, 20 bp, Artificial sequence
  Synthetic Oligonucleotide
cctataacagtatcactgta

SEQ ID NO: 1077 - DNA, 20 bp, Artificial sequence
  Synthetic Oligonucleotide
acctataacagtatcactgt

SEQ ID NO: 1078 - DNA, 20 bp, Artificial sequence
  Synthetic Oligonucleotide
gtacctataacagtatcact

SEQ ID NO: 1079 - DNA, 20 bp, Artificial sequence
  Synthetic Oligonucleotide
tgtacctataacagtatcac

SEQ ID NO: 1080 - DNA, 20 bp, Artificial sequence
  Synthetic Oligonucleotide
tcactgtacctataacagta

SEQ ID NO: 1081 - DNA, 20 bp, Artificial sequence
  Synthetic Oligonucleotide
atcactgtacctataacagt

SEQ ID NO: 1082 - DNA, 20 bp, Artificial sequence
  Synthetic Oligonucleotide
tatcactgtacctataacag

SEQ ID NO: 1083 - DNA, 20 bp, Artificial sequence
  Synthetic Oligonucleotide
aatatcactgtcctataact

SEQ ID NO: 1084 - DNA, 20 bp, Artificial sequence
  Synthetic Oligonucleotide
caatatcactgtcctataac

SEQ ID NO: 1085 - DNA, 20 bp, Artificial sequence
  Synthetic Oligonucleotide
acaatatcactgtcctataa

SEQ ID NO: 1086 - DNA, 20 bp, Artificial sequence
  Synthetic Oligonucleotide
cgtactagtttcctataact

SEQ ID NO: 1087 - DNA, 20 bp, Artificial sequence
  Synthetic Oligonucleotide
actataacagtatcaccgta

SEQ ID NO: 1088 - DNA, 20 bp, Artificial sequence
  Synthetic Oligonucleotide
aactataacagtatcaccgt

SEQ ID NO: 1089 - DNA, 20 bp, Artificial sequence
  Synthetic Oligonucleotide
taactataacagtatcaccg

SEQ ID NO: 1090 - DNA, 20 bp, Artificial sequence
  Synthetic Oligonucleotide
acctataactataacagtat

SEQ ID NO: 1091 - DNA, 20 bp, Artificial sequence
  Synthetic Oligonucleotide
tacctataactataacagta

SEQ ID NO: 1092 - DNA, 20 bp, Artificial sequence
  Synthetic Oligonucleotide
gtacctataactataacagt

SEQ ID NO: 1093 - DNA, 20 bp, Artificial sequence
  Synthetic Oligonucleotide
tgtacctataactataacag

SEQ ID NO: 1094 - DNA, 20 bp, Artificial sequence
  Synthetic Oligonucleotide
atcactgtacctataactat

SEQ ID NO: 1095 - DNA, 20 bp, Artificial sequence
  Synthetic Oligonucleotide
tatcactgtacctataacta

SEQ ID NO: 1096 - DNA, 20 bp, Artificial sequence
  Synthetic Oligonucleotide
caactataacagtatcactg

SEQ ID NO: 1097 - DNA, 20 bp, Artificial sequence
  Synthetic Oligonucleotide
acaactataacagtatcact

SEQ ID NO: 1098 - DNA, 20 bp, Artificial sequence
  Synthetic Oligonucleotide
tacaactataacagtatcac

SEQ ID NO: 1099 - DNA, 20 bp, Artificial sequence
  Synthetic Oligonucleotide
ctacaactataacagtatca

SEQ ID NO: 1100 - DNA, 20 bp, Artificial sequence
  Synthetic Oligonucleotide
caatatcactgtcctacaac

SEQ ID NO: 1101 - DNA, 20 bp, Artificial sequence
  Synthetic Oligonucleotide
gaatatcactgtcctataac

SEQ ID NO: 1102 - DNA, 20 bp, Artificial sequence
  Synthetic Oligonucleotide
acaatatcactgtaccttta

SEQ ID NO: 1103 - DNA, 20 bp, Artificial sequence
  Synthetic Oligonucleotide
tgtcctataactataacaat

SEQ ID NO: 1104 - DNA, 20 bp, Artificial sequence
  Synthetic Oligonucleotide
ctgtcctataactataacaa

SEQ ID NO: 1105 - DNA, 20 bp, Artificial sequence
  Synthetic Oligonucleotide
gcacctggcagaacagtacc

SEQ ID NO: 1106 - DNA, 20 bp, Artificial sequence
  Synthetic Oligonucleotide
gacagtgggccagagccttg

SEQ ID NO: 1107 - DNA, 20 bp, Artificial sequence
  Synthetic Oligonucleotide
acatcactgtcctataacta

SEQ ID NO: 1108 - DNA, 20 bp, Artificial sequence
  Synthetic Oligonucleotide
gtacctatatcactgtaact

SEQ ID NO: 1109 - DNA, 20 bp, Artificial sequence
  Synthetic Oligonucleotide
atatcactgtacctatatca

SEQ ID NO: 1110 - DNA, 20 bp, Artificial sequence
  Synthetic Oligonucleotide
tcactgtcctataactatat

SEQ ID NO: 1111 - DNA, 20 bp, Artificial sequence
  Synthetic Oligonucleotide
cgtcactgtacctataactg

SEQ ID NO: 1112 - DNA, 20 bp, Artificial sequence
  Synthetic Oligonucleotide
atcactgtcctataactatt

SEQ ID NO: 1113 - DNA, 20 bp, Artificial sequence
  Synthetic Oligonucleotide
aacatcactgtacctataac

SEQ ID NO: 1114 - DNA, 20 bp, Artificial sequence
  Synthetic Oligonucleotide
gccatccagggtgctctccc

SEQ ID NO: 1115 - DNA, 20 bp, Artificial sequence
  Synthetic Oligonucleotide
gcccccggagcaccttcact

SEQ ID NO: 1116 - DNA, 20 bp, Artificial sequence
  Synthetic Oligonucleotide
cgtggttagcctgacatctc

SEQ ID NO: 1117 - DNA, 20 bp, Artificial sequence
  Synthetic Oligonucleotide
gccatctggttagcctccga

SEQ ID NO: 1118 - DNA, 20 bp, Artificial sequence
  Synthetic Oligonucleotide
tacactgaacccccttaggc

SEQ ID NO: 1119 - DNA, 20 bp, Artificial sequence
  Synthetic Oligonucleotide
cagtttggcctttccatctc

SEQ ID NO: 1120 - DNA, 20 bp, Artificial sequence
  Synthetic Oligonucleotide
gccactaacccacctcttaa

SEQ ID NO: 1121 - DNA, 20 bp, Artificial sequence
  Synthetic Oligonucleotide
actcccatctactcccccat

SEQ ID NO: 1122 - DNA, 20 bp, Artificial sequence
  Synthetic Oligonucleotide
ctgctgattgtgtctggctc

SEQ ID NO: 1123 - DNA, 20 bp, Artificial sequence
  Synthetic Oligonucleotide
acaaggcttcgaggacagcc

SEQ ID NO: 1124 - DNA, 20 bp, Artificial sequence
  Synthetic Oligonucleotide
gcgattccttgcctctgctg

SEQ ID NO: 1125 - DNA, 20 bp, Artificial sequence
  Synthetic Oligonucleotide
caccgcgcgaatgcctgcct

SEQ ID NO: 1126 - DNA, 20 bp, Artificial sequence
  Synthetic Oligonucleotide
atccaacctctctccctatc

SEQ ID NO: 1127 - DNA, 20 bp, Artificial sequence
  Synthetic Oligonucleotide
gcccaagcctacatgcatac

SEQ ID NO: 1128 - DNA, 20 bp, Artificial sequence
  Synthetic Oligonucleotide
ggcctggatacagcctttct

SEQ ID NO: 1129 - DNA, 20 bp, Artificial sequence
  Synthetic Oligonucleotide
gtcccgaagagtcaagtcca

SEQ ID NO: 1130 - DNA, 20 bp, Artificial sequence
  Synthetic Oligonucleotide
actgttgtccatagcagcat

SEQ ID NO: 1131 - DNA, 20 bp, Artificial sequence
  Synthetic Oligonucleotide
agccctcaattgttgctggt

SEQ ID NO: 1132 - DNA, 20 bp, Artificial sequence
  Synthetic Oligonucleotide
gatgacctgcagatgcacag

SEQ ID NO: 1133 - DNA, 20 bp, Artificial sequence
  Synthetic Oligonucleotide
caggatagaactgatggtcc

SEQ ID NO: 1134 - DNA, 20 bp, Artificial sequence
  Synthetic Oligonucleotide
agaacaggagacaatccact

SEQ ID NO: 1135 - DNA, 20 bp, Artificial sequence
  Synthetic Oligonucleotide
gttcatgtggcaacctgtga

SEQ ID NO: 1136 - DNA, 20 bp, Artificial sequence
  Synthetic Oligonucleotide
catcactgtcctataactat

SEQ ID NO: 1137 - DNA, 20 bp, Artificial sequence
  Synthetic Oligonucleotide
tacctatatcactgtaacta

SEQ ID NO: 1138 - DNA, 20 bp, Artificial sequence
  Synthetic Oligonucleotide
tgtacctatatcactgtaac

SEQ ID NO: 1139 - DNA, 20 bp, Artificial sequence
  Synthetic Oligonucleotide
tatcactgtacctatatcac

SEQ ID NO: 1140 - DNA, 20 bp, Artificial sequence
  Synthetic Oligonucleotide
aatatcactgtacctatatc

SEQ ID NO: 1141 - DNA, 20 bp, Artificial sequence
  Synthetic Oligonucleotide
caatatcactgtacctatat

SEQ ID NO: 1142 - DNA, 20 bp, Artificial sequence
  Synthetic Oligonucleotide
actatatcactgtcctataa

SEQ ID NO: 1143 - DNA, 20 bp, Artificial sequence
  Synthetic Oligonucleotide
taactatatcactgtcctat

SEQ ID NO: 1144 - DNA, 20 bp, Artificial sequence
  Synthetic Oligonucleotide
ataactatatcactgtccta

SEQ ID NO: 1145 - DNA, 20 bp, Artificial sequence
  Synthetic Oligonucleotide
ctgtcctataactatatcac

SEQ ID NO: 1146 - DNA, 20 bp, Artificial sequence
  Synthetic Oligonucleotide
actgtcctataactatatca

SEQ ID NO: 1147 - DNA, 20 bp, Artificial sequence
  Synthetic Oligonucleotide
cactgtcctataactatatc

SEQ ID NO: 1148 - DNA, 20 bp, Artificial sequence
  Synthetic Oligonucleotide
gtaacaatatcactgtccta

SEQ ID NO: 1149 - DNA, 20 bp, Artificial sequence
  Synthetic Oligonucleotide
ctgtaacaatatcactgtcc

SEQ ID NO: 1150 - DNA, 20 bp, Artificial sequence
  Synthetic Oligonucleotide
actgtaacaatatcactgtc

SEQ ID NO: 1151 - DNA, 20 bp, Artificial sequence
  Synthetic Oligonucleotide
cactgtacctataactgtaa

SEQ ID NO: 1152 - DNA, 20 bp, Artificial sequence
  Synthetic Oligonucleotide
tcactgtacctataactgta

SEQ ID NO: 1153 - DNA, 20 bp, Artificial sequence
  Synthetic Oligonucleotide
gtcactgtacctataactgt

SEQ ID NO: 1154 - DNA, 20 bp, Artificial sequence
  Synthetic Oligonucleotide
actgtcctataactattaca

SEQ ID NO: 1155 - DNA, 20 bp, Artificial sequence
  Synthetic Oligonucleotide
cactgtcctataactattac

SEQ ID NO: 1156 - DNA, 20 bp, Artificial sequence
  Synthetic Oligonucleotide
tcactgtcctataactatta

SEQ ID NO: 1157 - DNA, 20 bp, Artificial sequence
  Synthetic Oligonucleotide
acctataactataacaatat

SEQ ID NO: 1158 - DNA, 20 bp, Artificial sequence
  Synthetic Oligonucleotide
tacctataactataacaata

SEQ ID NO: 1159 - DNA, 20 bp, Artificial sequence
  Synthetic Oligonucleotide
gtacctataactataacaat

SEQ ID NO: 1160 - DNA, 20 bp, Artificial sequence
  Synthetic Oligonucleotide
catcactgtacctataacta

SEQ ID NO: 1161 - DNA, 20 bp, Artificial sequence
  Synthetic Oligonucleotide
acatcactgtacctataact

SEQ ID NO: 1162 - DNA, 20 bp, Artificial sequence
  Synthetic Oligonucleotide
caacatcactgtacctataa

SEQ ID NO: 1163 - DNA, 20 bp, Artificial sequence
  Synthetic Oligonucleotide
acatcttgtcattaacatcc

SEQ ID NO: 1164 - DNA, 20 bp, Artificial sequence
  Synthetic Oligonucleotide
gcacccaatacagggccagg

SEQ ID NO: 1165 - DNA, 20 bp, Artificial sequence
  Synthetic Oligonucleotide
tgcctcctggcagccttcaa

SEQ ID NO: 1166 - DNA, 20 bp, Artificial sequence
  Synthetic Oligonucleotide
tgaaaagccacgcccttagc

SEQ ID NO: 1167 - DNA, 20 bp, Artificial sequence
  Synthetic Oligonucleotide
gccaggagacagccctactc

SEQ ID NO: 1168 - DNA, 20 bp, Artificial sequence
  Synthetic Oligonucleotide
agcccaatgtcctaacctgt

SEQ ID NO: 1169 - DNA, 20 bp, Artificial sequence
  Synthetic Oligonucleotide
tgcggttatatgggctgaag

SEQ ID NO: 1170 - DNA, 20 bp, Artificial sequence
  Synthetic Oligonucleotide
cctttagccactcctcttgc

SEQ ID NO: 1171 - DNA, 20 bp, Artificial sequence
  Synthetic Oligonucleotide
ccccatggtaccaaagccat

SEQ ID NO: 1172 - DNA, 20 bp, Artificial sequence
  Synthetic Oligonucleotide
ctcaatgccaccctttcccc

SEQ ID NO: 1173 - DNA, 20 bp, Artificial sequence
  Synthetic Oligonucleotide
ctgtctaactggcctggctg

SEQ ID NO: 1174 - DNA, 20 bp, Artificial sequence
  Synthetic Oligonucleotide
ggtcagaaggcctcttattc

SEQ ID NO: 1175 - DNA, 20 bp, Artificial sequence
  Synthetic Oligonucleotide
ccatctgtcccctcaatccc

SEQ ID NO: 1176 - DNA, 20 bp, Artificial sequence
  Synthetic Oligonucleotide
actctggcactggtcatgga

SEQ ID NO: 1177 - DNA, 20 bp, Artificial sequence
  Synthetic Oligonucleotide
ataaagtgcgattaagcccc

SEQ ID NO: 1178 - DNA, 20 bp, Artificial sequence
  Synthetic Oligonucleotide
taccaagcttgtagaaggga

SEQ ID NO: 1179 - DNA, 20 bp, Artificial sequence
  Synthetic Oligonucleotide
gaaagacggccaatgggaaa

SEQ ID NO: 1180 - DNA, 20 bp, Artificial sequence
  Synthetic Oligonucleotide
ctctatcaaaatcctgctgc

SEQ ID NO: 1181 - DNA, 20 bp, Artificial sequence
  Synthetic Oligonucleotide
ctccagtcaccaccattgcc

SEQ ID NO: 1182 - DNA, 20 bp, Artificial sequence
  Synthetic Oligonucleotide
aagagtaagccttcacaggg

SEQ ID NO: 1183 - DNA, 20 bp, Artificial sequence
  Synthetic Oligonucleotide
ctcaccagagttgtccccag

SEQ ID NO: 1184 - DNA, 20 bp, Artificial sequence
  Synthetic Oligonucleotide
gcagctcacacccaaaaagc

SEQ ID NO: 1185 - DNA, 20 bp, Artificial sequence
  Synthetic Oligonucleotide
tctgttaccttgaggattgt

SEQ ID NO: 1186 - DNA, 20 bp, Artificial sequence
  Synthetic Oligonucleotide
cgccatctgccctgtacaga

SEQ ID NO: 1187 - DNA, 20 bp, Artificial sequence
  Synthetic Oligonucleotide
ttggtggtgggattggtggt

SEQ ID NO: 1188 - DNA, 20 bp, Artificial sequence
  Synthetic Oligonucleotide
aattggtggtgggattggtg

SEQ ID NO: 1189 - DNA, 20 bp, Artificial sequence
  Synthetic Oligonucleotide
gaattggtggtgggattggt

SEQ ID NO: 1190 - DNA, 20 bp, Artificial sequence
  Synthetic Oligonucleotide
ggcaggattggtggtggaat

SEQ ID NO: 1191 - DNA, 20 bp, Artificial sequence
  Synthetic Oligonucleotide
tgagattggtggtgggtggc

SEQ ID NO: 1192 - DNA, 20 bp, Artificial sequence
  Synthetic Oligonucleotide
ggtggtgggattggtgctga

SEQ ID NO: 1193 - DNA, 20 bp, Artificial sequence
  Synthetic Oligonucleotide
gtaggtggtgggattggtgg

SEQ ID NO: 1194 - DNA, 20 bp, Artificial sequence
  Synthetic Oligonucleotide
ggtaggtggtgggattggtg

SEQ ID NO: 1195 - DNA, 20 bp, Artificial sequence
  Synthetic Oligonucleotide
ggtggcgggattggtggtgg

SEQ ID NO: 1196 - DNA, 20 bp, Artificial sequence
  Synthetic Oligonucleotide
gatcggtggtgggattggtc

SEQ ID NO: 1197 - DNA, 20 bp, Artificial sequence
  Synthetic Oligonucleotide
ggatcggtggtgggattggt

SEQ ID NO: 1198 - DNA, 20 bp, Artificial sequence
  Synthetic Oligonucleotide
ttggtggcgggatcggtggt

SEQ ID NO: 1199 - DNA, 20 bp, Artificial sequence
  Synthetic Oligonucleotide
attggtggcgggatcggtgg

SEQ ID NO: 1200 - DNA, 20 bp, Artificial sequence
  Synthetic Oligonucleotide
gattggtggcgggatcggtg

SEQ ID NO: 1201 - DNA, 20 bp, Artificial sequence
  Synthetic Oligonucleotide
ggattggtggcgggatcggt

SEQ ID NO: 1202 - DNA, 20 bp, Artificial sequence
  Synthetic Oligonucleotide
tggtggtgggattggtggtt

SEQ ID NO: 1203 - DNA, 20 bp, Artificial sequence
  Synthetic Oligonucleotide
tcttctagggccacacctct

SEQ ID NO: 1204 - DNA, 20 bp, Artificial sequence
  Synthetic Oligonucleotide
tggtcccaaattggagtgca

SEQ ID NO: 1205 - DNA, 20 bp, Artificial sequence
  Synthetic Oligonucleotide
tctctatacagctgggcaca

SEQ ID NO: 1206 - DNA, 20 bp, Artificial sequence
  Synthetic Oligonucleotide
cacttcccagcaaccctcac

SEQ ID NO: 1207 - DNA, 20 bp, Artificial sequence
  Synthetic Oligonucleotide
gctcctggcagcaatgaccc

SEQ ID NO: 1208 - DNA, 20 bp, Artificial sequence
  Synthetic Oligonucleotide
gggtatcttcactgttccag

SEQ ID NO: 1209 - DNA, 20 bp, Artificial sequence
  Synthetic Oligonucleotide
cgtcatgcttacctttctcc

SEQ ID NO: 1210 - DNA, 20 bp, Artificial sequence
  Synthetic Oligonucleotide
gccctccgagctttggcaac

SEQ ID NO: 1211 - DNA, 20 bp, Artificial sequence
  Synthetic Oligonucleotide
gcagccccccagaaatccca

SEQ ID NO: 1212 - DNA, 20 bp, Artificial sequence
  Synthetic Oligonucleotide
tctcaagcagcctattgtgt

SEQ ID NO: 1213 - DNA, 20 bp, Artificial sequence
  Synthetic Oligonucleotide
gtgcaagaccttgcttgcca

SEQ ID NO: 1214 - DNA, 20 bp, Artificial sequence
  Synthetic Oligonucleotide
ctgtagtccactacacagca

SEQ ID NO: 1215 - DNA, 20 bp, Artificial sequence
  Synthetic Oligonucleotide
tctccctgagtcacagtgga

SEQ ID NO: 1216 - DNA, 20 bp, Artificial sequence
  Synthetic Oligonucleotide
ccaggtgcagcacggagagg

SEQ ID NO: 1217 - DNA, 20 bp, Artificial sequence
  Synthetic Oligonucleotide
tagaatggcagggttctgtg

SEQ ID NO: 1218 - DNA, 20 bp, Artificial sequence
  Synthetic Oligonucleotide
gatgcatccaacacttaccc

SEQ ID NO: 1219 - DNA, 20 bp, Artificial sequence
  Synthetic Oligonucleotide
attggtggtgggattggtgg

SEQ ID NO: 1220 - DNA, 20 bp, Artificial sequence
  Synthetic Oligonucleotide
gcaggattggtggtggaatt

SEQ ID NO: 1221 - DNA, 20 bp, Artificial sequence
  Synthetic Oligonucleotide
tggcaggattggtggtggaa

SEQ ID NO: 1222 - DNA, 20 bp, Artificial sequence
  Synthetic Oligonucleotide
gagattggtggtgggtggca

SEQ ID NO: 1223 - DNA, 20 bp, Artificial sequence
  Synthetic Oligonucleotide
gtgagattggtggtgggtgg

SEQ ID NO: 1224 - DNA, 20 bp, Artificial sequence
  Synthetic Oligonucleotide
gattggtggtgggattggtg

SEQ ID NO: 1225 - DNA, 20 bp, Artificial sequence
  Synthetic Oligonucleotide
ggattggtggtgggattggt

SEQ ID NO: 1226 - DNA, 20 bp, Artificial sequence
  Synthetic Oligonucleotide
aggattggtggtgggattgg

SEQ ID NO: 1227 - DNA, 20 bp, Artificial sequence
  Synthetic Oligonucleotide
taggattggtggtgggattg

SEQ ID NO: 1228 - DNA, 20 bp, Artificial sequence
  Synthetic Oligonucleotide
gtaggattggtggtgggatt

SEQ ID NO: 1229 - DNA, 20 bp, Artificial sequence
  Synthetic Oligonucleotide
ggtaggattggtggtgggat

SEQ ID NO: 1230 - DNA, 20 bp, Artificial sequence
  Synthetic Oligonucleotide
tggtaggattggtggtggga

SEQ ID NO: 1231 - DNA, 20 bp, Artificial sequence
  Synthetic Oligonucleotide
tggtggtgggattggtgctg

SEQ ID NO: 1232 - DNA, 20 bp, Artificial sequence
  Synthetic Oligonucleotide
ttggtggtgggattggtgct

SEQ ID NO: 1233 - DNA, 20 bp, Artificial sequence
  Synthetic Oligonucleotide
attggtggtgggattggtgc

SEQ ID NO: 1234 - DNA, 20 bp, Artificial sequence
  Synthetic Oligonucleotide
aggtggtgggattggtggtg

SEQ ID NO: 1235 - DNA, 20 bp, Artificial sequence
  Synthetic Oligonucleotide
taggtggtgggattggtggt

SEQ ID NO: 1236 - DNA, 20 bp, Artificial sequence
  Synthetic Oligonucleotide
atcggtggtgggattggtcg

SEQ ID NO: 1237 - DNA, 20 bp, Artificial sequence
  Synthetic Oligonucleotide
ggtggtgggattggtggcgg

SEQ ID NO: 1238 - DNA, 20 bp, Artificial sequence
  Synthetic Oligonucleotide
tggtggtgggattggtggcg

SEQ ID NO: 1239 - DNA, 20 bp, Artificial sequence
  Synthetic Oligonucleotide
ttggtggtgggattggtggc

SEQ ID NO: 1240 - DNA, 20 bp, Artificial sequence
  Synthetic Oligonucleotide
gttggtggcgggatcggtgg

SEQ ID NO: 1241 - DNA, 20 bp, Artificial sequence
  Synthetic Oligonucleotide
ggttggtggcgggatcggtg

SEQ ID NO: 1242 - DNA, 20 bp, Artificial sequence
  Synthetic Oligonucleotide
tggttggtggcgggatcggt

SEQ ID NO: 1243 - DNA, 20 bp, Artificial sequence
  Synthetic Oligonucleotide
gtggttggtggcgggatcgg

SEQ ID NO: 1244 - DNA, 20 bp, Artificial sequence
  Synthetic Oligonucleotide
gggattggtggttggtggcg

SEQ ID NO: 1245 - DNA, 20 bp, Artificial sequence
  Synthetic Oligonucleotide
gggtcttgctccacccacat

SEQ ID NO: 1246 - DNA, 20 bp, Artificial sequence
  Synthetic Oligonucleotide
ccaagtagtgcaaggcatgt

SEQ ID NO: 1247 - DNA, 20 bp, Artificial sequence
  Synthetic Oligonucleotide
atcatgcttactgcaagtga

SEQ ID NO: 1248 - DNA, 20 bp, Artificial sequence
  Synthetic Oligonucleotide
tgaaactgggcagtccttcc

SEQ ID NO: 1249 - DNA, 20 bp, Artificial sequence
  Synthetic Oligonucleotide
ccaccttcttacatatgcta

SEQ ID NO: 1250 - DNA, 20 bp, Artificial sequence
  Synthetic Oligonucleotide
gcctctcagacggcacagac

SEQ ID NO: 1251 - DNA, 20 bp, Artificial sequence
  Synthetic Oligonucleotide
ttgccctcacacattcgaat

SEQ ID NO: 1252 - DNA, 20 bp, Artificial sequence
  Synthetic Oligonucleotide
tgctttctgcccaacctcta

SEQ ID NO: 1253 - DNA, 20 bp, Artificial sequence
  Synthetic Oligonucleotide
ctgtgctcccggccattagc

SEQ ID NO: 1254 - DNA, 20 bp, Artificial sequence
  Synthetic Oligonucleotide
gagacagtttggcaagctac

SEQ ID NO: 1255 - DNA, 20 bp, Artificial sequence
  Synthetic Oligonucleotide
ggagagagacggcaccctgt

SEQ ID NO: 1256 - DNA, 20 bp, Artificial sequence
  Synthetic Oligonucleotide
tcacctgtgagtaaccaata

SEQ ID NO: 1257 - DNA, 20 bp, Artificial sequence
  Synthetic Oligonucleotide
cccctcttaaatagcacatg

SEQ ID NO: 1258 - DNA, 20 bp, Artificial sequence
  Synthetic Oligonucleotide
ccaagtatctcatgtgcctg

SEQ ID NO: 1259 - DNA, 16 bp, Artificial sequence
  Synthetic Oligonucleotide
ctagtttcctataact

SEQ ID NO: 1260 - DNA, 16 bp, Artificial sequence
  Synthetic Oligonucleotide
actagtttcctataac

SEQ ID NO: 1261 - DNA, 16 bp, Artificial sequence
  Synthetic Oligonucleotide
tactagtttcctataa

SEQ ID NO: 1262 - DNA, 16 bp, Artificial sequence
  Synthetic Oligonucleotide
gtactagtttcctata

SEQ ID NO: 1263 - DNA, 16 bp, Artificial sequence
  Synthetic Oligonucleotide
tgtactagtttcctat

SEQ ID NO: 1264 - DNA, 16 bp, Artificial sequence
  Synthetic Oligonucleotide
ctgtactagtttccta

SEQ ID NO: 1265 - DNA, 16 bp, Artificial sequence
  Synthetic Oligonucleotide
actgtactagtttcct

SEQ ID NO: 1266 - DNA, 16 bp, Artificial sequence
  Synthetic Oligonucleotide
cactgtactagtttcc

SEQ ID NO: 1267 - DNA, 16 bp, Artificial sequence
  Synthetic Oligonucleotide
tcactgtactagtttc

SEQ ID NO: 1268 - DNA, 16 bp, Artificial sequence
  Synthetic Oligonucleotide
atcactgtactagttt

SEQ ID NO: 1269 - DNA, 16 bp, Artificial sequence
  Synthetic Oligonucleotide
tatcactgtactagtt

SEQ ID NO: 1270 - DNA, 17 bp, Artificial sequence
  Synthetic Oligonucleotide
actagtttcctataact

SEQ ID NO: 1271 - DNA, 17 bp, Artificial sequence
  Synthetic Oligonucleotide
tactagtttcctataac

SEQ ID NO: 1272 - DNA, 17 bp, Artificial sequence
  Synthetic Oligonucleotide
gtactagtttcctataa

SEQ ID NO: 1273 - DNA, 17 bp, Artificial sequence
  Synthetic Oligonucleotide
tgtactagtttcctata

SEQ ID NO: 1274 - DNA, 17 bp, Artificial sequence
  Synthetic Oligonucleotide
ctgtactagtttcctat

SEQ ID NO: 1275 - DNA, 17 bp, Artificial sequence
  Synthetic Oligonucleotide
actgtactagtttccta

SEQ ID NO: 1276 - DNA, 17 bp, Artificial sequence
  Synthetic Oligonucleotide
cactgtactagtttcct

SEQ ID NO: 1277 - DNA, 17 bp, Artificial sequence
  Synthetic Oligonucleotide
tcactgtactagtttcc

SEQ ID NO: 1278 - DNA, 17 bp, Artificial sequence
  Synthetic Oligonucleotide
atcactgtactagtttc

SEQ ID NO: 1279 - DNA, 17 bp, Artificial sequence
  Synthetic Oligonucleotide
tatcactgtactagttt

SEQ ID NO: 1280 - DNA, 18 bp, Artificial sequence
  Synthetic Oligonucleotide
tactagtttcctataact

SEQ ID NO: 1281 - DNA, 18 bp, Artificial sequence
  Synthetic Oligonucleotide
gtactagtttcctataac

SEQ ID NO: 1282 - DNA, 18 bp, Artificial sequence
  Synthetic Oligonucleotide
tgtactagtttcctataa

SEQ ID NO: 1283 - DNA, 18 bp, Artificial sequence
  Synthetic Oligonucleotide
ctgtactagtttcctata

SEQ ID NO: 1284 - DNA, 18 bp, Artificial sequence
  Synthetic Oligonucleotide
actgtactagtttcctat

SEQ ID NO: 1285 - DNA, 18 bp, Artificial sequence
  Synthetic Oligonucleotide
cactgtactagtttccta

SEQ ID NO: 1286 - DNA, 18 bp, Artificial sequence
  Synthetic Oligonucleotide
tcactgtactagtttcct

SEQ ID NO: 1287 - DNA, 18 bp, Artificial sequence
  Synthetic Oligonucleotide
atcactgtactagtttcc

SEQ ID NO: 1288 - DNA, 18 bp, Artificial sequence
  Synthetic Oligonucleotide
tatcactgtactagtttc

SEQ ID NO: 1289 - DNA, 17 bp, Artificial sequence
  Synthetic Oligonucleotide
gtatcactgtactagtt

SEQ ID NO: 1290 - DNA, 17 bp, Artificial sequence
  Synthetic Oligonucleotide
agtatcactgtactagt

SEQ ID NO: 1291 - DNA, 17 bp, Artificial sequence
  Synthetic Oligonucleotide
cagtatcactgtactag

SEQ ID NO: 1292 - DNA, 17 bp, Artificial sequence
  Synthetic Oligonucleotide
aacagtatcactgtact

SEQ ID NO: 1293 - DNA, 17 bp, Artificial sequence
  Synthetic Oligonucleotide
taacagtatcactgtac

SEQ ID NO: 1294 - DNA, 17 bp, Artificial sequence
  Synthetic Oligonucleotide
ctaacagtatcactgta

SEQ ID NO: 1295 - DNA, 17 bp, Artificial sequence
  Synthetic Oligonucleotide
tctaacagtatcactgt

SEQ ID NO: 1296 - DNA, 17 bp, Artificial sequence
  Synthetic Oligonucleotide
ctctaacagtatcactg

SEQ ID NO: 1297 - DNA, 17 bp, Artificial sequence
  Synthetic Oligonucleotide
tatcactgtcctataac

SEQ ID NO: 1298 - DNA, 17 bp, Artificial sequence
  Synthetic Oligonucleotide
atatcactgtcctataa

SEQ ID NO: 1299 - DNA, 17 bp, Artificial sequence
  Synthetic Oligonucleotide
tatatcactgtcctata

SEQ ID NO: 1300 - DNA, 17 bp, Artificial sequence
  Synthetic Oligonucleotide
tatcactgtcctatatc

SEQ ID NO: 1301 - DNA, 17 bp, Artificial sequence
  Synthetic Oligonucleotide
gtatcactgtcctatat

SEQ ID NO: 1302 - DNA, 17 bp, Artificial sequence
  Synthetic Oligonucleotide
agtatcactgtcctata

SEQ ID NO: 1303 - DNA, 17 bp, Artificial sequence
  Synthetic Oligonucleotide
taacagtatcactgtcc

SEQ ID NO: 1304 - DNA, 17 bp, Artificial sequence
  Synthetic Oligonucleotide
ataacagtatcactgtc

SEQ ID NO: 1305 - DNA, 17 bp, Artificial sequence
  Synthetic Oligonucleotide
tataacagtatcactgt

SEQ ID NO: 1306 - DNA, 17 bp, Artificial sequence
  Synthetic Oligonucleotide
ctataacagtatcactg

SEQ ID NO: 1307 - DNA, 17 bp, Artificial sequence
  Synthetic Oligonucleotide
cctataactataacagt

SEQ ID NO: 1308 - DNA, 17 bp, Artificial sequence
  Synthetic Oligonucleotide
tcctataactataacag

SEQ ID NO: 1309 - DNA, 17 bp, Artificial sequence
  Synthetic Oligonucleotide
cctataactataacaat

SEQ ID NO: 1310 - DNA, 17 bp, Artificial sequence
  Synthetic Oligonucleotide
gtaacagtatcactgta

SEQ ID NO: 1311 - DNA, 17 bp, Artificial sequence
  Synthetic Oligonucleotide
ataacagtatcactgta

SEQ ID NO: 1312 - DNA, 17 bp, Artificial sequence
  Synthetic Oligonucleotide
gtcctataactataaca

SEQ ID NO: 1313 - DNA, 17 bp, Artificial sequence
  Synthetic Oligonucleotide
tgtcctataactataac

SEQ ID NO: 1314 - DNA, 17 bp, Artificial sequence
  Synthetic Oligonucleotide
acctataactataacag

SEQ ID NO: 1315 - DNA, 17 bp, Artificial sequence
  Synthetic Oligonucleotide
tacctataactataaca

SEQ ID NO: 1316 - DNA, 17 bp, Artificial sequence
  Synthetic Oligonucleotide
acctataactataacaa

SEQ ID NO: 1317 - DNA, 16 bp, Artificial sequence
  Synthetic Oligonucleotide
cctttctccttcgaga

SEQ ID NO: 1318 - DNA, 16 bp, Artificial sequence
  Synthetic Oligonucleotide
acctttctccttcgag

SEQ ID NO: 1319 - DNA, 16 bp, Artificial sequence
  Synthetic Oligonucleotide
cacctttctccttcga

SEQ ID NO: 1320 - DNA, 16 bp, Artificial sequence
  Synthetic Oligonucleotide
atttgttaccaaagga

SEQ ID NO: 1321 - DNA, 16 bp, Artificial sequence
  Synthetic Oligonucleotide
tcttcatttgttacca

SEQ ID NO: 1322 - DNA, 16 bp, Artificial sequence
  Synthetic Oligonucleotide
ccttctttatagccag

SEQ ID NO: 1323 - DNA, 16 bp, Artificial sequence
  Synthetic Oligonucleotide
cccttctttatagcca

SEQ ID NO: 1324 - DNA, 16 bp, Artificial sequence
  Synthetic Oligonucleotide
ccccttctttatagcc

SEQ ID NO: 1325 - DNA, 16 bp, Artificial sequence
  Synthetic Oligonucleotide
aagcatcttttccccc

SEQ ID NO: 1326 - DNA, 16 bp, Artificial sequence
  Synthetic Oligonucleotide
agggaccacctgaatc

SEQ ID NO: 1327 - DNA, 16 bp, Artificial sequence
  Synthetic Oligonucleotide
aagggaccacctgaat

SEQ ID NO: 1328 - DNA, 16 bp, Artificial sequence
  Synthetic Oligonucleotide
taagggaccacctgaa

SEQ ID NO: 1329 - DNA, 16 bp, Artificial sequence
  Synthetic Oligonucleotide
ctaagggaccacctga

SEQ ID NO: 1330 - DNA, 16 bp, Artificial sequence
  Synthetic Oligonucleotide
actaagggaccacctg

SEQ ID NO: 1331 - DNA, 16 bp, Artificial sequence
  Synthetic Oligonucleotide
aactaagggaccacct

SEQ ID NO: 1332 - DNA, 16 bp, Artificial sequence
  Synthetic Oligonucleotide
aaactaagggaccacc

SEQ ID NO: 1333 - DNA, 16 bp, Artificial sequence
  Synthetic Oligonucleotide
caaactaagggaccac

SEQ ID NO: 1334 - DNA, 16 bp, Artificial sequence
  Synthetic Oligonucleotide
tgcaaactaagggacc

SEQ ID NO: 1335 - DNA, 16 bp, Artificial sequence
  Synthetic Oligonucleotide
ttgcaaactaagggac

SEQ ID NO: 1336 - DNA, 16 bp, Artificial sequence
  Synthetic Oligonucleotide
tttgcaaactaaggga

SEQ ID NO: 1337 - DNA, 16 bp, Artificial sequence
  Synthetic Oligonucleotide
gtttgcaaactaaggg

SEQ ID NO: 1338 - DNA, 16 bp, Artificial sequence
  Synthetic Oligonucleotide
tgtttgcaaactaagg

SEQ ID NO: 1339 - DNA, 16 bp, Artificial sequence
  Synthetic Oligonucleotide
gtgtttgcaaactaag

SEQ ID NO: 1340 - DNA, 16 bp, Artificial sequence
  Synthetic Oligonucleotide
tgctccctgcgggcac

SEQ ID NO: 1341 - DNA, 16 bp, Artificial sequence
  Synthetic Oligonucleotide
agacaccaggttgctc

SEQ ID NO: 1342 - DNA, 16 bp, Artificial sequence
  Synthetic Oligonucleotide
ctcagcgactttggtg

SEQ ID NO: 1343 - DNA, 16 bp, Artificial sequence
  Synthetic Oligonucleotide
actcagcgactttggt

SEQ ID NO: 1344 - DNA, 16 bp, Artificial sequence
  Synthetic Oligonucleotide
tactcagcgactttgg

SEQ ID NO: 1345 - DNA, 16 bp, Artificial sequence
  Synthetic Oligonucleotide
gtactcagcgactttg

SEQ ID NO: 1346 - DNA, 16 bp, Artificial sequence
  Synthetic Oligonucleotide
tgtactcagcgacttt

SEQ ID NO: 1347 - DNA, 16 bp, Artificial sequence
  Synthetic Oligonucleotide
atgtactcagcgactt

SEQ ID NO: 1348 - DNA, 16 bp, Artificial sequence
  Synthetic Oligonucleotide
catgtactcagcgact

SEQ ID NO: 1349 - DNA, 16 bp, Artificial sequence
  Synthetic Oligonucleotide
ccatgtactcagcgac

SEQ ID NO: 1350 - DNA, 16 bp, Artificial sequence
  Synthetic Oligonucleotide
tccatgtactcagcga

SEQ ID NO: 1351 - DNA, 16 bp, Artificial sequence
  Synthetic Oligonucleotide
gagcttttccatcact

SEQ ID NO: 1352 - DNA, 16 bp, Artificial sequence
  Synthetic Oligonucleotide
gcatctgagcttttcc

SEQ ID NO: 1353 - DNA, 16 bp, Artificial sequence
  Synthetic Oligonucleotide
tgcatctgagcttttc

SEQ ID NO: 1354 - DNA, 16 bp, Artificial sequence
  Synthetic Oligonucleotide
gactgcatctgagctt

SEQ ID NO: 1355 - DNA, 16 bp, Artificial sequence
  Synthetic Oligonucleotide
gtgactgcatctgagc

SEQ ID NO: 1356 - DNA, 16 bp, Artificial sequence
  Synthetic Oligonucleotide
ggtgactgcatctgag

SEQ ID NO: 1357 - DNA, 16 bp, Artificial sequence
  Synthetic Oligonucleotide
tggtgactgcatctga

SEQ ID NO: 1358 - DNA, 16 bp, Artificial sequence
  Synthetic Oligonucleotide
catgctggtgactgca

SEQ ID NO: 1359 - DNA, 16 bp, Artificial sequence
  Synthetic Oligonucleotide
tcatgctggtgactgc

SEQ ID NO: 1360 - DNA, 16 bp, Artificial sequence
  Synthetic Oligonucleotide
ctcatgctggtgactg

SEQ ID NO: 1361 - DNA, 16 bp, Artificial sequence
  Synthetic Oligonucleotide
tctcatgctggtgact

SEQ ID NO: 1362 - DNA, 16 bp, Artificial sequence
  Synthetic Oligonucleotide
tggactgcttctcatg

SEQ ID NO: 1363 - DNA, 16 bp, Artificial sequence
  Synthetic Oligonucleotide
tctggactgcttctca

SEQ ID NO: 1364 - DNA, 16 bp, Artificial sequence
  Synthetic Oligonucleotide
ctctggactgcttctc

SEQ ID NO: 1365 - DNA, 16 bp, Artificial sequence
  Synthetic Oligonucleotide
agactctggactgctt

SEQ ID NO: 1366 - DNA, 16 bp, Artificial sequence
  Synthetic Oligonucleotide
tagactctggactgct

SEQ ID NO: 1367 - DNA, 16 bp, Artificial sequence
  Synthetic Oligonucleotide
ctagactctggactgc

SEQ ID NO: 1368 - DNA, 16 bp, Artificial sequence
  Synthetic Oligonucleotide
tgcctagactctggac

SEQ ID NO: 1369 - DNA, 16 bp, Artificial sequence
  Synthetic Oligonucleotide
ttgcctagactctgga

SEQ ID NO: 1370 - DNA, 16 bp, Artificial sequence
  Synthetic Oligonucleotide
attgcctagactctgg

SEQ ID NO: 1371 - DNA, 16 bp, Artificial sequence
  Synthetic Oligonucleotide
tttgacttgaactcag

SEQ ID NO: 1372 - DNA, 16 bp, Artificial sequence
  Synthetic Oligonucleotide
atttgacttgaactca

SEQ ID NO: 1373 - DNA, 16 bp, Artificial sequence
  Synthetic Oligonucleotide
aatttgacttgaactc

SEQ ID NO: 1374 - DNA, 16 bp, Artificial sequence
  Synthetic Oligonucleotide
gaatttgacttgaact

SEQ ID NO: 1375 - DNA, 16 bp, Artificial sequence
  Synthetic Oligonucleotide
agaatttgacttgaac

SEQ ID NO: 1376 - DNA, 16 bp, Artificial sequence
  Synthetic Oligonucleotide
cagaatttgacttgaa

SEQ ID NO: 1377 - DNA, 16 bp, Artificial sequence
  Synthetic Oligonucleotide
tcagaatttgacttga

SEQ ID NO: 1378 - DNA, 16 bp, Artificial sequence
  Synthetic Oligonucleotide
ggctcagaatttgact

SEQ ID NO: 1379 - DNA, 16 bp, Artificial sequence
  Synthetic Oligonucleotide
aggctcagaatttgac

SEQ ID NO: 1380 - DNA, 16 bp, Artificial sequence
  Synthetic Oligonucleotide
ccccaggctcagaatt

SEQ ID NO: 1381 - DNA, 16 bp, Artificial sequence
  Synthetic Oligonucleotide
agatgaggacccccca

SEQ ID NO: 1382 - DNA, 16 bp, Artificial sequence
  Synthetic Oligonucleotide
cagatgaggacccccc

SEQ ID NO: 1383 - DNA, 16 bp, Artificial sequence
  Synthetic Oligonucleotide
gcagatgaggaccccc

SEQ ID NO: 1384 - DNA, 16 bp, Artificial sequence
  Synthetic Oligonucleotide
actctccatgctttgc

SEQ ID NO: 1385 - DNA, 16 bp, Artificial sequence
  Synthetic Oligonucleotide
cactctccatgctttg

SEQ ID NO: 1386 - DNA, 16 bp, Artificial sequence
  Synthetic Oligonucleotide
atgccactctccatgc

SEQ ID NO: 1387 - DNA, 16 bp, Artificial sequence
  Synthetic Oligonucleotide
atgcaaagaagatgcc

SEQ ID NO: 1388 - DNA, 16 bp, Artificial sequence
  Synthetic Oligonucleotide
gtccttaggatgcaaa

SEQ ID NO: 1389 - DNA, 16 bp, Artificial sequence
  Synthetic Oligonucleotide
cgtccttaggatgcaa

SEQ ID NO: 1390 - DNA, 16 bp, Artificial sequence
  Synthetic Oligonucleotide
gcagctctgagtgcac

SEQ ID NO: 1391 - DNA, 16 bp, Artificial sequence
  Synthetic Oligonucleotide
gacattgtcctcagca

SEQ ID NO: 1392 - DNA, 16 bp, Artificial sequence
  Synthetic Oligonucleotide
cagacattgtcctcag

SEQ ID NO: 1393 - DNA, 16 bp, Artificial sequence
  Synthetic Oligonucleotide
cacttatttgatgacc

SEQ ID NO: 1394 - DNA, 16 bp, Artificial sequence
  Synthetic Oligonucleotide
gcacttatttgatgac

SEQ ID NO: 1395 - DNA, 16 bp, Artificial sequence
  Synthetic Oligonucleotide
cgatggcaagcactta

SEQ ID NO: 1396 - DNA, 16 bp, Artificial sequence
  Synthetic Oligonucleotide
tcgatggcaagcactt

SEQ ID NO: 1397 - DNA, 16 bp, Artificial sequence
  Synthetic Oligonucleotide
ctcgatggcaagcact

SEQ ID NO: 1398 - DNA, 16 bp, Artificial sequence
  Synthetic Oligonucleotide
atgtctcgatggcaag

SEQ ID NO: 1399 - DNA, 16 bp, Artificial sequence
  Synthetic Oligonucleotide
aatgtctcgatggcaa

SEQ ID NO: 1400 - DNA, 16 bp, Artificial sequence
  Synthetic Oligonucleotide
aaatgtctcgatggca

SEQ ID NO: 1401 - DNA, 16 bp, Artificial sequence
  Synthetic Oligonucleotide
taaatgtctcgatggc

SEQ ID NO: 1402 - DNA, 16 bp, Artificial sequence
  Synthetic Oligonucleotide
ataaatgtctcgatgg

SEQ ID NO: 1403 - DNA, 16 bp, Artificial sequence
  Synthetic Oligonucleotide
tataaatgtctcgatg

SEQ ID NO: 1404 - DNA, 16 bp, Artificial sequence
  Synthetic Oligonucleotide
atcaactcctttataa

SEQ ID NO: 1405 - DNA, 16 bp, Artificial sequence
  Synthetic Oligonucleotide
tatcaactcctttata

SEQ ID NO: 1406 - DNA, 16 bp, Artificial sequence
  Synthetic Oligonucleotide
catatcaactccttta

SEQ ID NO: 1407 - DNA, 16 bp, Artificial sequence
  Synthetic Oligonucleotide
ctctcatatcaactcc

SEQ ID NO: 1408 - DNA, 16 bp, Artificial sequence
  Synthetic Oligonucleotide
cctctcatatcaactc

SEQ ID NO: 1409 - DNA, 16 bp, Artificial sequence
  Synthetic Oligonucleotide
tcctctcatatcaact

SEQ ID NO: 1410 - DNA, 16 bp, Artificial sequence
  Synthetic Oligonucleotide
actcctctcatatcaa

SEQ ID NO: 1411 - DNA, 16 bp, Artificial sequence
  Synthetic Oligonucleotide
gactcctctcatatca

SEQ ID NO: 1412 - DNA, 16 bp, Artificial sequence
  Synthetic Oligonucleotide
tgactcctctcatatc

SEQ ID NO: 1413 - DNA, 16 bp, Artificial sequence
  Synthetic Oligonucleotide
ttgactcctctcatat

SEQ ID NO: 1414 - DNA, 16 bp, Artificial sequence
  Synthetic Oligonucleotide
aaaattgactcctctc

SEQ ID NO: 1415 - DNA, 16 bp, Artificial sequence
  Synthetic Oligonucleotide
ttaaaattgactcctc

SEQ ID NO: 1416 - DNA, 16 bp, Artificial sequence
  Synthetic Oligonucleotide
ccttagacacattaaa

SEQ ID NO: 1417 - DNA, 16 bp, Artificial sequence
  Synthetic Oligonucleotide
accttagacacattaa

SEQ ID NO: 1418 - DNA, 16 bp, Artificial sequence
  Synthetic Oligonucleotide
aaccttagacacatta

SEQ ID NO: 1419 - DNA, 16 bp, Artificial sequence
  Synthetic Oligonucleotide
ctaaccttagacacat

SEQ ID NO: 1420 - DNA, 16 bp, Artificial sequence
  Synthetic Oligonucleotide
gctaaccttagacaca

SEQ ID NO: 1421 - DNA, 16 bp, Artificial sequence
  Synthetic Oligonucleotide
tgctaaccttagacac

SEQ ID NO: 1422 - DNA, 16 bp, Artificial sequence
  Synthetic Oligonucleotide
ctgctaaccttagaca

SEQ ID NO: 1423 - DNA, 16 bp, Artificial sequence
  Synthetic Oligonucleotide
actgctaaccttagac

SEQ ID NO: 1424 - DNA, 16 bp, Artificial sequence
  Synthetic Oligonucleotide
cactgctaaccttaga

SEQ ID NO: 1425 - DNA, 16 bp, Artificial sequence
  Synthetic Oligonucleotide
acactgctaaccttag

SEQ ID NO: 1426 - DNA, 16 bp, Artificial sequence
  Synthetic Oligonucleotide
aacactgctaacctta

SEQ ID NO: 1427 - DNA, 16 bp, Artificial sequence
  Synthetic Oligonucleotide
tcaacactgctaacct

SEQ ID NO: 1428 - DNA, 16 bp, Artificial sequence
  Synthetic Oligonucleotide
ttcaacactgctaacc

SEQ ID NO: 1429 - DNA, 16 bp, Artificial sequence
  Synthetic Oligonucleotide
attcttcaacactgct

SEQ ID NO: 1430 - DNA, 16 bp, Artificial sequence
  Synthetic Oligonucleotide
ctggcagcgaatgtta

SEQ ID NO: 1431 - DNA, 16 bp, Artificial sequence
  Synthetic Oligonucleotide
actggcagcgaatgtt

SEQ ID NO: 1432 - DNA, 16 bp, Artificial sequence
  Synthetic Oligonucleotide
cgtggcatatgaaaaa

SEQ ID NO: 1433 - DNA, 16 bp, Artificial sequence
  Synthetic Oligonucleotide
ctctgccttgtgaaat

SEQ ID NO: 1434 - DNA, 16 bp, Artificial sequence
  Synthetic Oligonucleotide
cggtactctgccttgt

SEQ ID NO: 1435 - DNA, 16 bp, Artificial sequence
  Synthetic Oligonucleotide
ttccggtactctgcct

SEQ ID NO: 1436 - DNA, 16 bp, Artificial sequence
  Synthetic Oligonucleotide
ttgttccggtactctg

SEQ ID NO: 1437 - DNA, 16 bp, Artificial sequence
  Synthetic Oligonucleotide
attgttccggtactct

SEQ ID NO: 1438 - DNA, 16 bp, Artificial sequence
  Synthetic Oligonucleotide
caattgttccggtact

SEQ ID NO: 1439 - DNA, 16 bp, Artificial sequence
  Synthetic Oligonucleotide
gcaattgttccggtac

SEQ ID NO: 1440 - DNA, 16 bp, Artificial sequence
  Synthetic Oligonucleotide
ggcaattgttccggta

SEQ ID NO: 1441 - DNA, 16 bp, Artificial sequence
  Synthetic Oligonucleotide
ctttaataggcaattg

SEQ ID NO: 1442 - DNA, 16 bp, Artificial sequence
  Synthetic Oligonucleotide
gtactttaataggcaa

SEQ ID NO: 1443 - DNA, 16 bp, Artificial sequence
  Synthetic Oligonucleotide
tgtactttaataggca

SEQ ID NO: 1444 - DNA, 16 bp, Artificial sequence
  Synthetic Oligonucleotide
ctgtactttaataggc

SEQ ID NO: 1445 - DNA, 16 bp, Artificial sequence
  Synthetic Oligonucleotide
actgtactttaatagg

SEQ ID NO: 1446 - DNA, 16 bp, Artificial sequence
  Synthetic Oligonucleotide
ctcagcacctttatag

SEQ ID NO: 1447 - DNA, 16 bp, Artificial sequence
  Synthetic Oligonucleotide
actcagcacctttata

SEQ ID NO: 1448 - DNA, 16 bp, Artificial sequence
  Synthetic Oligonucleotide
tactcagcacctttat

SEQ ID NO: 1449 - DNA, 16 bp, Artificial sequence
  Synthetic Oligonucleotide
ttactcagcaccttta

SEQ ID NO: 1450 - DNA, 16 bp, Artificial sequence
  Synthetic Oligonucleotide
atttctgaaagggcac

SEQ ID NO: 1451 - DNA, 16 bp, Artificial sequence
  Synthetic Oligonucleotide
caatttctgaaagggc

SEQ ID NO: 1452 - DNA, 16 bp, Artificial sequence
  Synthetic Oligonucleotide
ccaatttctgaaaggg

SEQ ID NO: 1453 - DNA, 16 bp, Artificial sequence
  Synthetic Oligonucleotide
accaatttctgaaagg

SEQ ID NO: 1454 - DNA, 16 bp, Artificial sequence
  Synthetic Oligonucleotide
tggcaaccaatttctg

SEQ ID NO: 1455 - DNA, 16 bp, Artificial sequence
  Synthetic Oligonucleotide
atccacatctgagaac

SEQ ID NO: 1456 - DNA, 16 bp, Artificial sequence
  Synthetic Oligonucleotide
gcaacatccacatctg

SEQ ID NO: 1457 - DNA, 16 bp, Artificial sequence
  Synthetic Oligonucleotide
ggcaacatccacatct

SEQ ID NO: 1458 - DNA, 16 bp, Artificial sequence
  Synthetic Oligonucleotide
tggcaacatccacatc

SEQ ID NO: 1459 - DNA, 16 bp, Artificial sequence
  Synthetic Oligonucleotide
cctggcaacatccaca

SEQ ID NO: 1460 - DNA, 16 bp, Artificial sequence
  Synthetic Oligonucleotide
accctggcaacatcca

SEQ ID NO: 1461 - DNA, 16 bp, Artificial sequence
  Synthetic Oligonucleotide
aaccctggcaacatcc

SEQ ID NO: 1462 - DNA, 16 bp, Artificial sequence
  Synthetic Oligonucleotide
gaaccctggcaacatc

SEQ ID NO: 1463 - DNA, 16 bp, Artificial sequence
  Synthetic Oligonucleotide
tgaacggtcttcaagc

SEQ ID NO: 1464 - DNA, 16 bp, Artificial sequence
  Synthetic Oligonucleotide
atgaacggtcttcaag

SEQ ID NO: 1465 - DNA, 16 bp, Artificial sequence
  Synthetic Oligonucleotide
taaaaatgaacggtct

SEQ ID NO: 1466 - DNA, 16 bp, Artificial sequence
  Synthetic Oligonucleotide
gagtctcttgtcactt

SEQ ID NO: 1467 - DNA, 16 bp, Artificial sequence
  Synthetic Oligonucleotide
tgagtctcttgtcact

SEQ ID NO: 1468 - DNA, 16 bp, Artificial sequence
  Synthetic Oligonucleotide
ggtgagtctcttgtca

SEQ ID NO: 1469 - DNA, 16 bp, Artificial sequence
  Synthetic Oligonucleotide
aggtgagtctcttgtc

SEQ ID NO: 1470 - DNA, 16 bp, Artificial sequence
  Synthetic Oligonucleotide
tggaggtgagtctctt

SEQ ID NO: 1471 - DNA, 16 bp, Artificial sequence
  Synthetic Oligonucleotide
ttggaggtgagtctct

SEQ ID NO: 1472 - DNA, 16 bp, Artificial sequence
  Synthetic Oligonucleotide
cttggaggtgagtctc

SEQ ID NO: 1473 - DNA, 16 bp, Artificial sequence
  Synthetic Oligonucleotide
tcttggaggtgagtct

SEQ ID NO: 1474 - DNA, 16 bp, Artificial sequence
  Synthetic Oligonucleotide
ttgcttcttggaggtg

SEQ ID NO: 1475 - DNA, 16 bp, Artificial sequence
  Synthetic Oligonucleotide
attgcttcttggaggt

SEQ ID NO: 1476 - DNA, 16 bp, Artificial sequence
  Synthetic Oligonucleotide
caattgcttcttggag

SEQ ID NO: 1477 - DNA, 16 bp, Artificial sequence
  Synthetic Oligonucleotide
cacaattgcttcttgg

SEQ ID NO: 1478 - DNA, 16 bp, Artificial sequence
  Synthetic Oligonucleotide
gcttgaataaaatcat

SEQ ID NO: 1479 - DNA, 16 bp, Artificial sequence
  Synthetic Oligonucleotide
gttgcttgcttgaata

SEQ ID NO: 1480 - DNA, 16 bp, Artificial sequence
  Synthetic Oligonucleotide
agttgcttgcttgaat

SEQ ID NO: 1481 - DNA, 16 bp, Artificial sequence
  Synthetic Oligonucleotide
aagttgcttgcttgaa

SEQ ID NO: 1482 - DNA, 16 bp, Artificial sequence
  Synthetic Oligonucleotide
taagttgcttgcttga

SEQ ID NO: 1483 - DNA, 16 bp, Artificial sequence
  Synthetic Oligonucleotide
gaaataagttgcttgc

SEQ ID NO: 1484 - DNA, 16 bp, Artificial sequence
  Synthetic Oligonucleotide
tgaaataagttgcttg

SEQ ID NO: 1485 - DNA, 16 bp, Artificial sequence
  Synthetic Oligonucleotide
actgtagcaaacaagg

SEQ ID NO: 1486 - DNA, 16 bp, Artificial sequence
  Synthetic Oligonucleotide
tccacaggaaactgta

SEQ ID NO: 1487 - DNA, 16 bp, Artificial sequence
  Synthetic Oligonucleotide
atccacaggaaactgt

SEQ ID NO: 1488 - DNA, 16 bp, Artificial sequence
  Synthetic Oligonucleotide
tcatagagttgagtca

SEQ ID NO: 1489 - DNA, 16 bp, Artificial sequence
  Synthetic Oligonucleotide
acctctgaagaaggcg

SEQ ID NO: 1490 - DNA, 16 bp, Artificial sequence
  Synthetic Oligonucleotide
atccccacctctgaag

SEQ ID NO: 1491 - DNA, 16 bp, Artificial sequence
  Synthetic Oligonucleotide
agctacatccccacct

SEQ ID NO: 1492 - DNA, 16 bp, Artificial sequence
  Synthetic Oligonucleotide
gaagctacatccccac

SEQ ID NO: 1493 - DNA, 16 bp, Artificial sequence
  Synthetic Oligonucleotide
acatggaagctacatc

SEQ ID NO: 1494 - DNA, 16 bp, Artificial sequence
  Synthetic Oligonucleotide
tacatggaagctacat

SEQ ID NO: 1495 - DNA, 16 bp, Artificial sequence
  Synthetic Oligonucleotide
gtacatggaagctaca

SEQ ID NO: 1496 - DNA, 16 bp, Artificial sequence
  Synthetic Oligonucleotide
tgtacatggaagctac

SEQ ID NO: 1497 - DNA, 16 bp, Artificial sequence
  Synthetic Oligonucleotide
gtgtacatggaagcta

SEQ ID NO: 1498 - DNA, 16 bp, Artificial sequence
  Synthetic Oligonucleotide
gggtgtacatggaagc

SEQ ID NO: 1499 - DNA, 16 bp, Artificial sequence
  Synthetic Oligonucleotide
gcagtattgggcattt

SEQ ID NO: 1500 - DNA, 16 bp, Artificial sequence
  Synthetic Oligonucleotide
catctggcagtattgg

SEQ ID NO: 1501 - DNA, 16 bp, Artificial sequence
  Synthetic Oligonucleotide
tcatctggcagtattg

SEQ ID NO: 1502 - DNA, 16 bp, Artificial sequence
  Synthetic Oligonucleotide
cctcatctggcagtat

SEQ ID NO: 1503 - DNA, 16 bp, Artificial sequence
  Synthetic Oligonucleotide
acctcatctggcagta

SEQ ID NO: 1504 - DNA, 16 bp, Artificial sequence
  Synthetic Oligonucleotide
gtgcacctcatctggc

SEQ ID NO: 1505 - DNA, 16 bp, Artificial sequence
  Synthetic Oligonucleotide
ggtggaatgtgcacct

SEQ ID NO: 1506 - DNA, 16 bp, Artificial sequence
  Synthetic Oligonucleotide
gggtggaatgtgcacc

SEQ ID NO: 1507 - DNA, 16 bp, Artificial sequence
  Synthetic Oligonucleotide
aacttgctggaagaaa

SEQ ID NO: 1508 - DNA, 16 bp, Artificial sequence
  Synthetic Oligonucleotide
gaacttgctggaagaa

SEQ ID NO: 1509 - DNA, 16 bp, Artificial sequence
  Synthetic Oligonucleotide
tgaacttgctggaaga

SEQ ID NO: 1510 - DNA, 16 bp, Artificial sequence
  Synthetic Oligonucleotide
gattgaacttgctgga

SEQ ID NO: 1511 - DNA, 16 bp, Artificial sequence
  Synthetic Oligonucleotide
cattgattgaacttgc

SEQ ID NO: 1512 - DNA, 16 bp, Artificial sequence
  Synthetic Oligonucleotide
tcattgattgaacttg

SEQ ID NO: 1513 - DNA, 16 bp, Artificial sequence
  Synthetic Oligonucleotide
caaaccttttctccat

SEQ ID NO: 1514 - DNA, 16 bp, Artificial sequence
  Synthetic Oligonucleotide
gcaaccaaaccttttc

SEQ ID NO: 1515 - DNA, 16 bp, Artificial sequence
  Synthetic Oligonucleotide
agcaaccaaacctttt

SEQ ID NO: 1516 - DNA, 16 bp, Artificial sequence
  Synthetic Oligonucleotide
cgatgtacttttggca

SEQ ID NO: 1517 - DNA, 16 bp, Artificial sequence
  Synthetic Oligonucleotide
tcgatgtacttttggc

SEQ ID NO: 1518 - DNA, 16 bp, Artificial sequence
  Synthetic Oligonucleotide
ttcgatgtacttttgg

SEQ ID NO: 1519 - DNA, 16 bp, Artificial sequence
  Synthetic Oligonucleotide
gttcgatgtacttttg

SEQ ID NO: 1520 - DNA, 16 bp, Artificial sequence
  Synthetic Oligonucleotide
cctgttcgatgtactt

SEQ ID NO: 1521 - DNA, 16 bp, Artificial sequence
  Synthetic Oligonucleotide
acctgttcgatgtact

SEQ ID NO: 1522 - DNA, 16 bp, Artificial sequence
  Synthetic Oligonucleotide
gcacctgttcgatgta

SEQ ID NO: 1523 - DNA, 16 bp, Artificial sequence
  Synthetic Oligonucleotide
ctgcacctgttcgatg

SEQ ID NO: 1524 - DNA, 16 bp, Artificial sequence
  Synthetic Oligonucleotide
actgcacctgttcgat

SEQ ID NO: 1525 - DNA, 16 bp, Artificial sequence
  Synthetic Oligonucleotide
aactgcacctgttcga

SEQ ID NO: 1526 - DNA, 16 bp, Artificial sequence
  Synthetic Oligonucleotide
aaactgcacctgttcg

SEQ ID NO: 1527 - DNA, 16 bp, Artificial sequence
  Synthetic Oligonucleotide
ccagaaactgcacctg

SEQ ID NO: 1528 - DNA, 16 bp, Artificial sequence
  Synthetic Oligonucleotide
tccagaaactgcacct

SEQ ID NO: 1529 - DNA, 16 bp, Artificial sequence
  Synthetic Oligonucleotide
tgtccagaaactgcac

SEQ ID NO: 1530 - DNA, 16 bp, Artificial sequence
  Synthetic Oligonucleotide
cttcaaggaatgtcca

SEQ ID NO: 1531 - DNA, 16 bp, Artificial sequence
  Synthetic Oligonucleotide
gcttcaaggaatgtcc

SEQ ID NO: 1532 - DNA, 16 bp, Artificial sequence
  Synthetic Oligonucleotide
ttgcttcaaggaatgt

SEQ ID NO: 1533 - DNA, 16 bp, Artificial sequence
  Synthetic Oligonucleotide
cacattgcttcaagga

SEQ ID NO: 1534 - DNA, 16 bp, Artificial sequence
  Synthetic Oligonucleotide
gatgaccacattgctt

SEQ ID NO: 1535 - DNA, 16 bp, Artificial sequence
  Synthetic Oligonucleotide
ctcatatcaactcctt

SEQ ID NO: 1536 - DNA, 16 bp, Artificial sequence
  Synthetic Oligonucleotide
caacactgctaacctt

SEQ ID NO: 1537 - DNA, 16 bp, Artificial sequence
  Synthetic Oligonucleotide
ccggtactctgccttg

SEQ ID NO: 1538 - DNA, 16 bp, Artificial sequence
  Synthetic Oligonucleotide
tccggtactctgcctt

SEQ ID NO: 1539 - DNA, 16 bp, Artificial sequence
  Synthetic Oligonucleotide
aggcaattgttccggt

SEQ ID NO: 1540 - DNA, 16 bp, Artificial sequence
  Synthetic Oligonucleotide
taggcaattgttccgg

SEQ ID NO: 1541 - DNA, 16 bp, Artificial sequence
  Synthetic Oligonucleotide
ataggcaattgttccg

SEQ ID NO: 1542 - DNA, 16 bp, Artificial sequence
  Synthetic Oligonucleotide
gagaaccctggcaaca

SEQ ID NO: 1543 - DNA, 16 bp, Artificial sequence
  Synthetic Oligonucleotide
tgagaaccctggcaac

SEQ ID NO: 1544 - DNA, 16 bp, Artificial sequence
  Synthetic Oligonucleotide
tggagtgagaaccctg

SEQ ID NO: 1545 - DNA, 16 bp, Artificial sequence
  Synthetic Oligonucleotide
atctggagtgagaacc

SEQ ID NO: 1546 - DNA, 16 bp, Artificial sequence
  Synthetic Oligonucleotide
gtccgacacacaaaag

SEQ ID NO: 1547 - DNA, 16 bp, Artificial sequence
  Synthetic Oligonucleotide
ggtccgacacacaaaa

SEQ ID NO: 1548 - DNA, 16 bp, Artificial sequence
  Synthetic Oligonucleotide
atggtccgacacacaa

SEQ ID NO: 1549 - DNA, 16 bp, Artificial sequence
  Synthetic Oligonucleotide
gatggtccgacacaca

SEQ ID NO: 1550 - DNA, 16 bp, Artificial sequence
  Synthetic Oligonucleotide
agatggtccgacacac

SEQ ID NO: 1551 - DNA, 16 bp, Artificial sequence
  Synthetic Oligonucleotide
tgataggtgcagatgg

SEQ ID NO: 1552 - DNA, 16 bp, Artificial sequence
  Synthetic Oligonucleotide
gtgataggtgcagatg

SEQ ID NO: 1553 - DNA, 16 bp, Artificial sequence
  Synthetic Oligonucleotide
cgattttccatacatt

SEQ ID NO: 1554 - DNA, 16 bp, Artificial sequence
  Synthetic Oligonucleotide
tcgattttccatacat

SEQ ID NO: 1555 - DNA, 16 bp, Artificial sequence
  Synthetic Oligonucleotide
ctcgattttccataca

SEQ ID NO: 1556 - DNA, 16 bp, Artificial sequence
  Synthetic Oligonucleotide
actcgattttccatac

SEQ ID NO: 1557 - DNA, 16 bp, Artificial sequence
  Synthetic Oligonucleotide
gactcgattttccata

SEQ ID NO: 1558 - DNA, 16 bp, Artificial sequence
  Synthetic Oligonucleotide
tgtgactcgattttcc

SEQ ID NO: 1559 - DNA, 16 bp, Artificial sequence
  Synthetic Oligonucleotide
ttgtgactcgattttc

SEQ ID NO: 1560 - DNA, 16 bp, Artificial sequence
  Synthetic Oligonucleotide
tttgtgactcgatttt

SEQ ID NO: 1561 - DNA, 16 bp, Artificial sequence
  Synthetic Oligonucleotide
tttctttgtgactcga

SEQ ID NO: 1562 - DNA, 16 bp, Artificial sequence
  Synthetic Oligonucleotide
gtgtgccactttcaga

SEQ ID NO: 1563 - DNA, 16 bp, Artificial sequence
  Synthetic Oligonucleotide
ggtgtgccactttcag

SEQ ID NO: 1564 - DNA, 16 bp, Artificial sequence
  Synthetic Oligonucleotide
tggtgtgccactttca

SEQ ID NO: 1565 - DNA, 16 bp, Artificial sequence
  Synthetic Oligonucleotide
acttggtgtgccactt

SEQ ID NO: 1566 - DNA, 16 bp, Artificial sequence
  Synthetic Oligonucleotide
aacttggtgtgccact

SEQ ID NO: 1567 - DNA, 16 bp, Artificial sequence
  Synthetic Oligonucleotide
gaacttggtgtgccac

SEQ ID NO: 1568 - DNA, 16 bp, Artificial sequence
  Synthetic Oligonucleotide
ggaacttggtgtgcca

SEQ ID NO: 1569 - DNA, 16 bp, Artificial sequence
  Synthetic Oligonucleotide
aggaacttggtgtgcc

SEQ ID NO: 1570 - DNA, 16 bp, Artificial sequence
  Synthetic Oligonucleotide
gtgttttcttgaggag

SEQ ID NO: 1571 - DNA, 16 bp, Artificial sequence
  Synthetic Oligonucleotide
ggtgttttcttgagga

SEQ ID NO: 1572 - DNA, 16 bp, Artificial sequence
  Synthetic Oligonucleotide
agatatggtgttttct

SEQ ID NO: 1573 - DNA, 16 bp, Artificial sequence
  Synthetic Oligonucleotide
cagatatggtgttttc

SEQ ID NO: 1574 - DNA, 16 bp, Artificial sequence
  Synthetic Oligonucleotide
ctatatccagatatgg

SEQ ID NO: 1575 - DNA, 16 bp, Artificial sequence
  Synthetic Oligonucleotide
taaaaggctatatcca

SEQ ID NO: 1576 - DNA, 16 bp, Artificial sequence
  Synthetic Oligonucleotide
gttaaaaggctatatc

SEQ ID NO: 1577 - DNA, 16 bp, Artificial sequence
  Synthetic Oligonucleotide
ggttaaaaggctatat

SEQ ID NO: 1578 - DNA, 16 bp, Artificial sequence
  Synthetic Oligonucleotide
caggttaaaaggctat

SEQ ID NO: 1579 - DNA, 16 bp, Artificial sequence
  Synthetic Oligonucleotide
gcaggttaaaaggcta

SEQ ID NO: 1580 - DNA, 16 bp, Artificial sequence
  Synthetic Oligonucleotide
tgcaggttaaaaggct

SEQ ID NO: 1581 - DNA, 16 bp, Artificial sequence
  Synthetic Oligonucleotide
ttgcaggttaaaaggc

SEQ ID NO: 1582 - DNA, 16 bp, Artificial sequence
  Synthetic Oligonucleotide
tttgcaggttaaaagg

SEQ ID NO: 1583 - DNA, 16 bp, Artificial sequence
  Synthetic Oligonucleotide
gttcaggtaaagttct

SEQ ID NO: 1584 - DNA, 16 bp, Artificial sequence
  Synthetic Oligonucleotide
ggttcaggtaaagttc

SEQ ID NO: 1585 - DNA, 16 bp, Artificial sequence
  Synthetic Oligonucleotide
gggttcaggtaaagtt

SEQ ID NO: 1586 - DNA, 16 bp, Artificial sequence
  Synthetic Oligonucleotide
agggttcaggtaaagt

SEQ ID NO: 1587 - DNA, 16 bp, Artificial sequence
  Synthetic Oligonucleotide
ggcagggttcaggtaa

SEQ ID NO: 1588 - DNA, 16 bp, Artificial sequence
  Synthetic Oligonucleotide
ttagaatggcagggtt

SEQ ID NO: 1589 - DNA, 16 bp, Artificial sequence
  Synthetic Oligonucleotide
tcccgggtaaatttta

SEQ ID NO: 1590 - DNA, 16 bp, Artificial sequence
  Synthetic Oligonucleotide
ctcccgggtaaatttt

SEQ ID NO: 1591 - DNA, 16 bp, Artificial sequence
  Synthetic Oligonucleotide
tcaactcccgggtaaa

SEQ ID NO: 1592 - DNA, 16 bp, Artificial sequence
  Synthetic Oligonucleotide
aagtcaactcccgggt

SEQ ID NO: 1593 - DNA, 16 bp, Artificial sequence
  Synthetic Oligonucleotide
aaagtcaactcccggg

SEQ ID NO: 1594 - DNA, 16 bp, Artificial sequence
  Synthetic Oligonucleotide
caaagtcaactcccgg

SEQ ID NO: 1595 - DNA, 16 bp, Artificial sequence
  Synthetic Oligonucleotide
ccaaagtcaactcccg

SEQ ID NO: 1596 - DNA, 16 bp, Artificial sequence
  Synthetic Oligonucleotide
cctccaaagtcaactc

SEQ ID NO: 1597 - DNA, 16 bp, Artificial sequence
  Synthetic Oligonucleotide
cttggcaaacattcac

SEQ ID NO: 1598 - DNA, 16 bp, Artificial sequence
  Synthetic Oligonucleotide
gtctcttggcaaacat

SEQ ID NO: 1599 - DNA, 16 bp, Artificial sequence
  Synthetic Oligonucleotide
aagtctcttggcaaac

SEQ ID NO: 1600 - DNA, 16 bp, Artificial sequence
  Synthetic Oligonucleotide
tctttgtgcaagtctc

SEQ ID NO: 1601 - DNA, 16 bp, Artificial sequence
  Synthetic Oligonucleotide
aatcatctttgtgcaa

SEQ ID NO: 1602 - DNA, 16 bp, Artificial sequence
  Synthetic Oligonucleotide
gaatcatctttgtgca

SEQ ID NO: 1603 - DNA, 16 bp, Artificial sequence
  Synthetic Oligonucleotide
cgaatcatctttgtgc

SEQ ID NO: 1604 - DNA, 16 bp, Artificial sequence
  Synthetic Oligonucleotide
gcgaatcatctttgtg

SEQ ID NO: 1605 - DNA, 16 bp, Artificial sequence
  Synthetic Oligonucleotide
cagcgaatcatctttg

SEQ ID NO: 1606 - DNA, 16 bp, Artificial sequence
  Synthetic Oligonucleotide
acagcgaatcatcttt

SEQ ID NO: 1607 - DNA, 16 bp, Artificial sequence
  Synthetic Oligonucleotide
tgacagcgaatcatct

SEQ ID NO: 1608 - DNA, 16 bp, Artificial sequence
  Synthetic Oligonucleotide
ctgacagcgaatcatc

SEQ ID NO: 1609 - DNA, 16 bp, Artificial sequence
  Synthetic Oligonucleotide
actgacagcgaatcat

SEQ ID NO: 1610 - DNA, 16 bp, Artificial sequence
  Synthetic Oligonucleotide
tacagtcttctgggag

SEQ ID NO: 1611 - DNA, 16 bp, Artificial sequence
  Synthetic Oligonucleotide
ccttacagtcttctgg

SEQ ID NO: 1612 - DNA, 16 bp, Artificial sequence
  Synthetic Oligonucleotide
tagataatcttaagaa

SEQ ID NO: 1613 - DNA, 16 bp, Artificial sequence
  Synthetic Oligonucleotide
ccatccatagataatc

SEQ ID NO: 1614 - DNA, 16 bp, Artificial sequence
  Synthetic Oligonucleotide
gtgtcccatacgcaat

SEQ ID NO: 1615 - DNA, 16 bp, Artificial sequence
  Synthetic Oligonucleotide
tgtgtcccatacgcaa

SEQ ID NO: 1616 - DNA, 16 bp, Artificial sequence
  Synthetic Oligonucleotide
ttgtgtcccatacgca

SEQ ID NO: 1617 - DNA, 16 bp, Artificial sequence
  Synthetic Oligonucleotide
cttgtgtcccatacgc

SEQ ID NO: 1618 - DNA, 16 bp, Artificial sequence
  Synthetic Oligonucleotide
ccttgtgtcccatacg

SEQ ID NO: 1619 - DNA, 16 bp, Artificial sequence
  Synthetic Oligonucleotide
cccttgtgtcccatac

SEQ ID NO: 1620 - DNA, 16 bp, Artificial sequence
  Synthetic Oligonucleotide
accagagctcccttgt

SEQ ID NO: 1621 - DNA, 16 bp, Artificial sequence
  Synthetic Oligonucleotide
aaccagagctcccttg

SEQ ID NO: 1622 - DNA, 16 bp, Artificial sequence
  Synthetic Oligonucleotide
taaccagagctccctt

SEQ ID NO: 1623 - DNA, 16 bp, Artificial sequence
  Synthetic Oligonucleotide
agtaaccagagctccc

SEQ ID NO: 1624 - DNA, 16 bp, Artificial sequence
  Synthetic Oligonucleotide
agagtaaccagagctc

SEQ ID NO: 1625 - DNA, 16 bp, Artificial sequence
  Synthetic Oligonucleotide
caaagagtaaccagag

SEQ ID NO: 1626 - DNA, 16 bp, Artificial sequence
  Synthetic Oligonucleotide
ctcaaagagtaaccag

SEQ ID NO: 1627 - DNA, 16 bp, Artificial sequence
  Synthetic Oligonucleotide
tctcaaagagtaacca

SEQ ID NO: 1628 - DNA, 16 bp, Artificial sequence
  Synthetic Oligonucleotide
gttacacaatctcaaa

SEQ ID NO: 1629 - DNA, 16 bp, Artificial sequence
  Synthetic Oligonucleotide
agtgttacacaatctc

SEQ ID NO: 1630 - DNA, 16 bp, Artificial sequence
  Synthetic Oligonucleotide
ccagtgttacacaatc

SEQ ID NO: 1631 - DNA, 16 bp, Artificial sequence
  Synthetic Oligonucleotide
tccccagtgttacaca

SEQ ID NO: 1632 - DNA, 16 bp, Artificial sequence
  Synthetic Oligonucleotide
gtccccagtgttacac

SEQ ID NO: 1633 - DNA, 16 bp, Artificial sequence
  Synthetic Oligonucleotide
tgtccccagtgttaca

SEQ ID NO: 1634 - DNA, 16 bp, Artificial sequence
  Synthetic Oligonucleotide
ttgtccccagtgttac

SEQ ID NO: 1635 - DNA, 16 bp, Artificial sequence
  Synthetic Oligonucleotide
aagagtttgttcctcc

SEQ ID NO: 1636 - DNA, 16 bp, Artificial sequence
  Synthetic Oligonucleotide
caagaagagtttgttc

SEQ ID NO: 1637 - DNA, 16 bp, Artificial sequence
  Synthetic Oligonucleotide
ccaagaagagtttgtt

SEQ ID NO: 1638 - DNA, 16 bp, Artificial sequence
  Synthetic Oligonucleotide
ccccaagaagagtttg

SEQ ID NO: 1639 - DNA, 16 bp, Artificial sequence
  Synthetic Oligonucleotide
tccccaagaagagttt

SEQ ID NO: 1640 - DNA, 16 bp, Artificial sequence
  Synthetic Oligonucleotide
cactctccccaagaag

SEQ ID NO: 1641 - DNA, 16 bp, Artificial sequence
  Synthetic Oligonucleotide
ccactctccccaagaa

SEQ ID NO: 1642 - DNA, 16 bp, Artificial sequence
  Synthetic Oligonucleotide
gcttcacctgcaggct

SEQ ID NO: 1643 - DNA, 16 bp, Artificial sequence
  Synthetic Oligonucleotide
gctgtcagcttcacct

SEQ ID NO: 1644 - DNA, 16 bp, Artificial sequence
  Synthetic Oligonucleotide
tgagctgtcagcttca

SEQ ID NO: 1645 - DNA, 16 bp, Artificial sequence
  Synthetic Oligonucleotide
gtcctatgagtgaccc

SEQ ID NO: 1646 - DNA, 16 bp, Artificial sequence
  Synthetic Oligonucleotide
gtgtcctatgagtgac

SEQ ID NO: 1647 - DNA, 16 bp, Artificial sequence
  Synthetic Oligonucleotide
ggtgtcctatgagtga

SEQ ID NO: 1648 - DNA, 16 bp, Artificial sequence
  Synthetic Oligonucleotide
tggtgtcctatgagtg

SEQ ID NO: 1649 - DNA, 16 bp, Artificial sequence
  Synthetic Oligonucleotide
ctggtgtcctatgagt

SEQ ID NO: 1650 - DNA, 16 bp, Artificial sequence
  Synthetic Oligonucleotide
gatgcgccaaacatcc

SEQ ID NO: 1651 - DNA, 16 bp, Artificial sequence
  Synthetic Oligonucleotide
agatgcgccaaacatc

SEQ ID NO: 1652 - DNA, 16 bp, Artificial sequence
  Synthetic Oligonucleotide
atagatgcgccaaaca

SEQ ID NO: 1653 - DNA, 16 bp, Artificial sequence
  Synthetic Oligonucleotide
cactatagatgcgcca

SEQ ID NO: 1654 - DNA, 16 bp, Artificial sequence
  Synthetic Oligonucleotide
ccactatagatgcgcc

SEQ ID NO: 1655 - DNA, 16 bp, Artificial sequence
  Synthetic Oligonucleotide
aatgtctgacagattt

SEQ ID NO: 1656 - DNA, 16 bp, Artificial sequence
  Synthetic Oligonucleotide
taatgtctgacagatt

SEQ ID NO: 1657 - DNA, 16 bp, Artificial sequence
  Synthetic Oligonucleotide
gaaaggtgtatctttt

SEQ ID NO: 1658 - DNA, 16 bp, Artificial sequence
  Synthetic Oligonucleotide
gtgagaaaggtgtatc

SEQ ID NO: 1659 - DNA, 16 bp, Artificial sequence
  Synthetic Oligonucleotide
tgtgagaaaggtgtat

SEQ ID NO: 1660 - DNA, 16 bp, Artificial sequence
  Synthetic Oligonucleotide
tttgtgagaaaggtgt

SEQ ID NO: 1661 - DNA, 16 bp, Artificial sequence
  Synthetic Oligonucleotide
atttgtgagaaaggtg

SEQ ID NO: 1662 - DNA, 16 bp, Artificial sequence
  Synthetic Oligonucleotide
tggtgaataataatct

SEQ ID NO: 1663 - DNA, 16 bp, Artificial sequence
  Synthetic Oligonucleotide
ttatagttttggtgaa

SEQ ID NO: 1664 - DNA, 16 bp, Artificial sequence
  Synthetic Oligonucleotide
tatcatgattcccttc

SEQ ID NO: 1665 - DNA, 16 bp, Artificial sequence
  Synthetic Oligonucleotide
gatatcatgattccct

SEQ ID NO: 1666 - DNA, 16 bp, Artificial sequence
  Synthetic Oligonucleotide
cgatatcatgattccc

SEQ ID NO: 1667 - DNA, 16 bp, Artificial sequence
  Synthetic Oligonucleotide
gcgatatcatgattcc

SEQ ID NO: 1668 - DNA, 16 bp, Artificial sequence
  Synthetic Oligonucleotide
aggcgatatcatgatt

SEQ ID NO: 1669 - DNA, 16 bp, Artificial sequence
  Synthetic Oligonucleotide
aaggcgatatcatgat

SEQ ID NO: 1670 - DNA, 16 bp, Artificial sequence
  Synthetic Oligonucleotide
caaaggagcctggagt

SEQ ID NO: 1671 - DNA, 16 bp, Artificial sequence
  Synthetic Oligonucleotide
attcaaaggagcctgg

SEQ ID NO: 1672 - DNA, 16 bp, Artificial sequence
  Synthetic Oligonucleotide
aattcaaaggagcctg

SEQ ID NO: 1673 - DNA, 16 bp, Artificial sequence
  Synthetic Oligonucleotide
gtaattcaaaggagcc

SEQ ID NO: 1674 - DNA, 16 bp, Artificial sequence
  Synthetic Oligonucleotide
gtgtaattcaaaggag

SEQ ID NO: 1675 - DNA, 16 bp, Artificial sequence
  Synthetic Oligonucleotide
catattggtttttgga

SEQ ID NO: 1676 - DNA, 16 bp, Artificial sequence
  Synthetic Oligonucleotide
gcatattggtttttgg

SEQ ID NO: 1677 - DNA, 16 bp, Artificial sequence
  Synthetic Oligonucleotide
taggcatattggtttt

SEQ ID NO: 1678 - DNA, 16 bp, Artificial sequence
  Synthetic Oligonucleotide
cttgtgtcacctttgg

SEQ ID NO: 1679 - DNA, 16 bp, Artificial sequence
  Synthetic Oligonucleotide
gcttgtgtcacctttg

SEQ ID NO: 1680 - DNA, 16 bp, Artificial sequence
  Synthetic Oligonucleotide
ataaattgtgcttgtg

SEQ ID NO: 1681 - DNA, 16 bp, Artificial sequence
  Synthetic Oligonucleotide
gtataaattgtgcttg

SEQ ID NO: 1682 - DNA, 16 bp, Artificial sequence
  Synthetic Oligonucleotide
tggtataaattgtgct

SEQ ID NO: 1683 - DNA, 16 bp, Artificial sequence
  Synthetic Oligonucleotide
ttggtataaattgtgc

SEQ ID NO: 1684 - DNA, 16 bp, Artificial sequence
  Synthetic Oligonucleotide
cagttggtataaattg

SEQ ID NO: 1685 - DNA, 16 bp, Artificial sequence
  Synthetic Oligonucleotide
caacagttggtataaa

SEQ ID NO: 1686 - DNA, 16 bp, Artificial sequence
  Synthetic Oligonucleotide
ccaacagttggtataa

SEQ ID NO: 1687 - DNA, 16 bp, Artificial sequence
  Synthetic Oligonucleotide
cccaacagttggtata

SEQ ID NO: 1688 - DNA, 16 bp, Artificial sequence
  Synthetic Oligonucleotide
agaagccccatccggt

SEQ ID NO: 1689 - DNA, 16 bp, Artificial sequence
  Synthetic Oligonucleotide
tttctccttcgagaag

SEQ ID NO: 1690 - DNA, 16 bp, Artificial sequence
  Synthetic Oligonucleotide
ctttctccttcgagaa

SEQ ID NO: 1691 - DNA, 16 bp, Artificial sequence
  Synthetic Oligonucleotide
gggcttcagccagaca

SEQ ID NO: 1692 - DNA, 16 bp, Artificial sequence
  Synthetic Oligonucleotide
cgggcttcagccagac

SEQ ID NO: 1693 - DNA, 16 bp, Artificial sequence
  Synthetic Oligonucleotide
tgctgaaagcgggctt

SEQ ID NO: 1694 - DNA, 16 bp, Artificial sequence
  Synthetic Oligonucleotide
gtgctgaaagcgggct

SEQ ID NO: 1695 - DNA, 16 bp, Artificial sequence
  Synthetic Oligonucleotide
cgtgctgaaagcgggc

SEQ ID NO: 1696 - DNA, 16 bp, Artificial sequence
  Synthetic Oligonucleotide
tcagcccctggttacg

SEQ ID NO: 1697 - DNA, 16 bp, Artificial sequence
  Synthetic Oligonucleotide
attgtcagcccctggt

SEQ ID NO: 1698 - DNA, 16 bp, Artificial sequence
  Synthetic Oligonucleotide
gcattgtcagcccctg

SEQ ID NO: 1699 - DNA, 16 bp, Artificial sequence
  Synthetic Oligonucleotide
cgcattgtcagcccct

SEQ ID NO: 1700 - DNA, 16 bp, Artificial sequence
  Synthetic Oligonucleotide
tcgcattgtcagcccc

SEQ ID NO: 1701 - DNA, 16 bp, Artificial sequence
  Synthetic Oligonucleotide
ctcgcattgtcagccc

SEQ ID NO: 1702 - DNA, 16 bp, Artificial sequence
  Synthetic Oligonucleotide
cctcgcattgtcagcc

SEQ ID NO: 1703 - DNA, 16 bp, Artificial sequence
  Synthetic Oligonucleotide
acctcgcattgtcagc

SEQ ID NO: 1704 - DNA, 16 bp, Artificial sequence
  Synthetic Oligonucleotide
gacctcgcattgtcag

SEQ ID NO: 1705 - DNA, 16 bp, Artificial sequence
  Synthetic Oligonucleotide
cgacctcgcattgtca

SEQ ID NO: 1706 - DNA, 16 bp, Artificial sequence
  Synthetic Oligonucleotide
gcgacctcgcattgtc

SEQ ID NO: 1707 - DNA, 16 bp, Artificial sequence
  Synthetic Oligonucleotide
tgcgacctcgcattgt

SEQ ID NO: 1708 - DNA, 16 bp, Artificial sequence
  Synthetic Oligonucleotide
ttgcgacctcgcattg

SEQ ID NO: 1709 - DNA, 16 bp, Artificial sequence
  Synthetic Oligonucleotide
gttgcgacctcgcatt

SEQ ID NO: 1710 - DNA, 16 bp, Artificial sequence
  Synthetic Oligonucleotide
agttgcgacctcgcat

SEQ ID NO: 1711 - DNA, 16 bp, Artificial sequence
  Synthetic Oligonucleotide
cagttgcgacctcgca

SEQ ID NO: 1712 - DNA, 16 bp, Artificial sequence
  Synthetic Oligonucleotide
tcagttgcgacctcgc

SEQ ID NO: 1713 - DNA, 16 bp, Artificial sequence
  Synthetic Oligonucleotide
ctcagttgcgacctcg

SEQ ID NO: 1714 - DNA, 16 bp, Artificial sequence
  Synthetic Oligonucleotide
tctcagttgcgacctc

SEQ ID NO: 1715 - DNA, 16 bp, Artificial sequence
  Synthetic Oligonucleotide
atctcagttgcgacct

SEQ ID NO: 1716 - DNA, 16 bp, Artificial sequence
  Synthetic Oligonucleotide
gatctcagttgcgacc

SEQ ID NO: 1717 - DNA, 16 bp, Artificial sequence
  Synthetic Oligonucleotide
agatctcagttgcgac

SEQ ID NO: 1718 - DNA, 16 bp, Artificial sequence
  Synthetic Oligonucleotide
gagatctcagttgcga

SEQ ID NO: 1719 - DNA, 16 bp, Artificial sequence
  Synthetic Oligonucleotide
ggagatctcagttgcg

SEQ ID NO: 1720 - DNA, 16 bp, Artificial sequence
  Synthetic Oligonucleotide
tcatggagatctcagt

SEQ ID NO: 1721 - DNA, 16 bp, Artificial sequence
  Synthetic Oligonucleotide
gtcatggagatctcag

SEQ ID NO: 1722 - DNA, 16 bp, Artificial sequence
  Synthetic Oligonucleotide
agtcatggagatctca

SEQ ID NO: 1723 - DNA, 16 bp, Artificial sequence
  Synthetic Oligonucleotide
cagtcatggagatctc

SEQ ID NO: 1724 - DNA, 16 bp, Artificial sequence
  Synthetic Oligonucleotide
acagtcatggagatct

SEQ ID NO: 1725 - DNA, 16 bp, Artificial sequence
  Synthetic Oligonucleotide
aacacacagtcatgga

SEQ ID NO: 1726 - DNA, 16 bp, Artificial sequence
  Synthetic Oligonucleotide
caacacacagtcatgg

SEQ ID NO: 1727 - DNA, 16 bp, Artificial sequence
  Synthetic Oligonucleotide
catcctatccgtgttc

SEQ ID NO: 1728 - DNA, 16 bp, Artificial sequence
  Synthetic Oligonucleotide
catgaacatcctatcc

SEQ ID NO: 1729 - DNA, 16 bp, Artificial sequence
  Synthetic Oligonucleotide
tattccatgaacatcc

SEQ ID NO: 1730 - DNA, 16 bp, Artificial sequence
  Synthetic Oligonucleotide
gtcaacatattccatg

SEQ ID NO: 1731 - DNA, 16 bp, Artificial sequence
  Synthetic Oligonucleotide
cctgtcaacatattcc

SEQ ID NO: 1732 - DNA, 16 bp, Artificial sequence
  Synthetic Oligonucleotide
tgtcctgtcaacatat

SEQ ID NO: 1733 - DNA, 16 bp, Artificial sequence
  Synthetic Oligonucleotide
gccaacagtttcaact

SEQ ID NO: 1734 - DNA, 16 bp, Artificial sequence
  Synthetic Oligonucleotide
ttctgccaacagtttc

SEQ ID NO: 1735 - DNA, 16 bp, Artificial sequence
  Synthetic Oligonucleotide
caatattgactttggg

SEQ ID NO: 1736 - DNA, 16 bp, Artificial sequence
  Synthetic Oligonucleotide
tgcttggcttcaatat

SEQ ID NO: 1737 - DNA, 16 bp, Artificial sequence
  Synthetic Oligonucleotide
actgcaggcaatattt

SEQ ID NO: 1738 - DNA, 16 bp, Artificial sequence
  Synthetic Oligonucleotide
gcactgcaggcaatat

SEQ ID NO: 1739 - DNA, 16 bp, Artificial sequence
  Synthetic Oligonucleotide
ctaatgtggcactgca

SEQ ID NO: 1740 - DNA, 16 bp, Artificial sequence
  Synthetic Oligonucleotide
tgttctaatgtggcac

SEQ ID NO: 1741 - DNA, 16 bp, Artificial sequence
  Synthetic Oligonucleotide
gctgttctaatgtggc

SEQ ID NO: 1742 - DNA, 16 bp, Artificial sequence
  Synthetic Oligonucleotide
tgactagtgaatggct

SEQ ID NO: 1743 - DNA, 16 bp, Artificial sequence
  Synthetic Oligonucleotide
tctgactagtgaatgg

SEQ ID NO: 1744 - DNA, 16 bp, Artificial sequence
  Synthetic Oligonucleotide
tcaatctgactagtga

SEQ ID NO: 1745 - DNA, 16 bp, Artificial sequence
  Synthetic Oligonucleotide
ggtcaatctgactagt

SEQ ID NO: 1746 - DNA, 16 bp, Artificial sequence
  Synthetic Oligonucleotide
ctggtcaatctgacta

SEQ ID NO: 1747 - DNA, 16 bp, Artificial sequence
  Synthetic Oligonucleotide
ctctggtcaatctgac

SEQ ID NO: 1748 - DNA, 16 bp, Artificial sequence
  Synthetic Oligonucleotide
caatctctggtcaatc

SEQ ID NO: 1749 - DNA, 16 bp, Artificial sequence
  Synthetic Oligonucleotide
caacaatctctggtca

SEQ ID NO: 1750 - DNA, 16 bp, Artificial sequence
  Synthetic Oligonucleotide
accaacaatctctggt

SEQ ID NO: 1751 - DNA, 16 bp, Artificial sequence
  Synthetic Oligonucleotide
agcccaccaacaatct

SEQ ID NO: 1752 - DNA, 16 bp, Artificial sequence
  Synthetic Oligonucleotide
gacagcccaccaacaa

SEQ ID NO: 1753 - DNA, 16 bp, Artificial sequence
  Synthetic Oligonucleotide
cagacagcccaccaac

SEQ ID NO: 1754 - DNA, 16 bp, Artificial sequence
  Synthetic Oligonucleotide
gcatagaccccaacag

SEQ ID NO: 1755 - DNA, 16 bp, Artificial sequence
  Synthetic Oligonucleotide
gtgcatagaccccaac

SEQ ID NO: 1756 - DNA, 16 bp, Artificial sequence
  Synthetic Oligonucleotide
ctgtgcatagacccca

SEQ ID NO: 1757 - DNA, 16 bp, Artificial sequence
  Synthetic Oligonucleotide
tcctgtgcatagaccc

SEQ ID NO: 1758 - DNA, 16 bp, Artificial sequence
  Synthetic Oligonucleotide
gaaatcctgtgcatag

SEQ ID NO: 1759 - DNA, 16 bp, Artificial sequence
  Synthetic Oligonucleotide
gcagaaatcctgtgca

SEQ ID NO: 1760 - DNA, 16 bp, Artificial sequence
  Synthetic Oligonucleotide
actccagcagaaatcc

SEQ ID NO: 1761 - DNA, 16 bp, Artificial sequence
  Synthetic Oligonucleotide
aatcatgccttgtggg

SEQ ID NO: 1762 - DNA, 16 bp, Artificial sequence
  Synthetic Oligonucleotide
tagacccagaatcatg

SEQ ID NO: 1763 - DNA, 16 bp, Artificial sequence
  Synthetic Oligonucleotide
ccatagacccagaatc

SEQ ID NO: 1764 - DNA, 16 bp, Artificial sequence
  Synthetic Oligonucleotide
agtcaccatagaccca

SEQ ID NO: 1765 - DNA, 16 bp, Artificial sequence
  Synthetic Oligonucleotide
taagtcaccatagacc

SEQ ID NO: 1766 - DNA, 16 bp, Artificial sequence
  Synthetic Oligonucleotide
gtggccctcttaagtc

SEQ ID NO: 1767 - DNA, 16 bp, Artificial sequence
  Synthetic Oligonucleotide
gttgtgtggccctctt

SEQ ID NO: 1768 - DNA, 16 bp, Artificial sequence
  Synthetic Oligonucleotide
cattgttgtgtggccc

SEQ ID NO: 1769 - DNA, 16 bp, Artificial sequence
  Synthetic Oligonucleotide
tactcattgttgtgtg

SEQ ID NO: 1770 - DNA, 16 bp, Artificial sequence
  Synthetic Oligonucleotide
aatactcattgttgtg

SEQ ID NO: 1771 - DNA, 16 bp, Artificial sequence
  Synthetic Oligonucleotide
gccatacatctgagga

SEQ ID NO: 1772 - DNA, 16 bp, Artificial sequence
  Synthetic Oligonucleotide
attgtagccatacatc

SEQ ID NO: 1773 - DNA, 16 bp, Artificial sequence
  Synthetic Oligonucleotide
ttattgtagccataca

SEQ ID NO: 1774 - DNA, 16 bp, Artificial sequence
  Synthetic Oligonucleotide
tctagatgacctgaag

SEQ ID NO: 1775 - DNA, 16 bp, Artificial sequence
  Synthetic Oligonucleotide
tacatctagatgacct

SEQ ID NO: 1776 - DNA, 16 bp, Artificial sequence
  Synthetic Oligonucleotide
gtatacatctagatga

SEQ ID NO: 1777 - DNA, 16 bp, Artificial sequence
  Synthetic Oligonucleotide
actcgcctttgtgact

SEQ ID NO: 1778 - DNA, 16 bp, Artificial sequence
  Synthetic Oligonucleotide
tactcgcctttgtgac

SEQ ID NO: 1779 - DNA, 16 bp, Artificial sequence
  Synthetic Oligonucleotide
atactcgcctttgtga

SEQ ID NO: 1780 - DNA, 16 bp, Artificial sequence
  Synthetic Oligonucleotide
catactcgcctttgtg

SEQ ID NO: 1781 - DNA, 16 bp, Artificial sequence
  Synthetic Oligonucleotide
gcatactcgcctttgt

SEQ ID NO: 1782 - DNA, 16 bp, Artificial sequence
  Synthetic Oligonucleotide
atgcatactcgccttt

SEQ ID NO: 1783 - DNA, 16 bp, Artificial sequence
  Synthetic Oligonucleotide
catgcatactcgcctt

SEQ ID NO: 1784 - DNA, 16 bp, Artificial sequence
  Synthetic Oligonucleotide
ccatgcatactcgcct

SEQ ID NO: 1785 - DNA, 16 bp, Artificial sequence
  Synthetic Oligonucleotide
ttccatgcatactcgc

SEQ ID NO: 1786 - DNA, 16 bp, Artificial sequence
  Synthetic Oligonucleotide
cgattttccatgcata

SEQ ID NO: 1787 - DNA, 16 bp, Artificial sequence
  Synthetic Oligonucleotide
tgcgattttccatgca

SEQ ID NO: 1788 - DNA, 16 bp, Artificial sequence
  Synthetic Oligonucleotide
tgtgatgcgattttcc

SEQ ID NO: 1789 - DNA, 16 bp, Artificial sequence
  Synthetic Oligonucleotide
ctttgtgatgcgattt

SEQ ID NO: 1790 - DNA, 16 bp, Artificial sequence
  Synthetic Oligonucleotide
gcctttgtgatgcgat

SEQ ID NO: 1791 - DNA, 16 bp, Artificial sequence
  Synthetic Oligonucleotide
actcgcctttgtgatg

SEQ ID NO: 1792 - DNA, 16 bp, Artificial sequence
  Synthetic Oligonucleotide
tactcgcctttgtgat

SEQ ID NO: 1793 - DNA, 16 bp, Artificial sequence
  Synthetic Oligonucleotide
cccatgcatactcgcc

SEQ ID NO: 1794 - DNA, 16 bp, Artificial sequence
  Synthetic Oligonucleotide
ccccatgcatactcgc

SEQ ID NO: 1795 - DNA, 16 bp, Artificial sequence
  Synthetic Oligonucleotide
gctccccatgcatact

SEQ ID NO: 1796 - DNA, 16 bp, Artificial sequence
  Synthetic Oligonucleotide
agtgctccccatgcat

SEQ ID NO: 1797 - DNA, 16 bp, Artificial sequence
  Synthetic Oligonucleotide
caagtgctccccatgc

SEQ ID NO: 1798 - DNA, 16 bp, Artificial sequence
  Synthetic Oligonucleotide
gtgatgaaagtacagc

SEQ ID NO: 1799 - DNA, 16 bp, Artificial sequence
  Synthetic Oligonucleotide
aggagtttgtcagaac

SEQ ID NO: 1800 - DNA, 16 bp, Artificial sequence
  Synthetic Oligonucleotide
ttcagggagtgatgtc

SEQ ID NO: 1801 - DNA, 16 bp, Artificial sequence
  Synthetic Oligonucleotide
cctatccgtgttcagc

SEQ ID NO: 1802 - DNA, 16 bp, Artificial sequence
  Synthetic Oligonucleotide
ctctacatactcagga

SEQ ID NO: 1803 - DNA, 16 bp, Artificial sequence
  Synthetic Oligonucleotide
cagtccaaaaatccct

SEQ ID NO: 1804 - DNA, 16 bp, Artificial sequence
  Synthetic Oligonucleotide
cctcttgatttgggca

SEQ ID NO: 1805 - DNA, 16 bp, Artificial sequence
  Synthetic Oligonucleotide
ttggccaactctgtgg

SEQ ID NO: 1806 - DNA, 16 bp, Artificial sequence
  Synthetic Oligonucleotide
gacctccagactactg

SEQ ID NO: 1807 - DNA, 16 bp, Artificial sequence
  Synthetic Oligonucleotide
tgtgtctagggagttg

SEQ ID NO: 1808 - DNA, 16 bp, Artificial sequence
  Synthetic Oligonucleotide
agcacacaattactgg

SEQ ID NO: 1809 - DNA, 16 bp, Artificial sequence
  Synthetic Oligonucleotide
ctgctggttttagacc

SEQ ID NO: 1810 - DNA, 16 bp, Artificial sequence
  Synthetic Oligonucleotide
ttcacttaccacagga

SEQ ID NO: 1811 - DNA, 16 bp, Artificial sequence
  Synthetic Oligonucleotide
ggtgccacttgcttgg

SEQ ID NO: 1812 - DNA, 16 bp, Artificial sequence
  Synthetic Oligonucleotide
aatctccacccccgaa

SEQ ID NO: 1813 - DNA, 16 bp, Artificial sequence
  Synthetic Oligonucleotide
tacctgacaagtggtc

SEQ ID NO: 1814 - DNA, 16 bp, Artificial sequence
  Synthetic Oligonucleotide
gtcccaagacattcct

SEQ ID NO: 1815 - DNA, 16 bp, Artificial sequence
  Synthetic Oligonucleotide
cagagtgtcatctgcg

SEQ ID NO: 1816 - DNA, 16 bp, Artificial sequence
  Synthetic Oligonucleotide
ggattggacccagaca

SEQ ID NO: 1817 - DNA, 16 bp, Artificial sequence
  Synthetic Oligonucleotide
ggttccctagcggtcc

SEQ ID NO: 1818 - DNA, 16 bp, Artificial sequence
  Synthetic Oligonucleotide
cacctagaactatcca

SEQ ID NO: 1819 - DNA, 16 bp, Artificial sequence
  Synthetic Oligonucleotide
ctccctctgtaatgat

SEQ ID NO: 1820 - DNA, 16 bp, Artificial sequence
  Synthetic Oligonucleotide
ggttgagggacagaca

SEQ ID NO: 1821 - DNA, 16 bp, Artificial sequence
  Synthetic Oligonucleotide
gtgggtttgcacatgg

SEQ ID NO: 1822 - DNA, 16 bp, Artificial sequence
  Synthetic Oligonucleotide
ggcttatgctccttct

SEQ ID NO: 1823 - DNA, 16 bp, Artificial sequence
  Synthetic Oligonucleotide
ccccctgtagttggct

SEQ ID NO: 1824 - DNA, 16 bp, Artificial sequence
  Synthetic Oligonucleotide
gcttacttacatccct

SEQ ID NO: 1825 - DNA, 16 bp, Artificial sequence
  Synthetic Oligonucleotide
gggactacatgcaata

SEQ ID NO: 1826 - DNA, 16 bp, Artificial sequence
  Synthetic Oligonucleotide
gtcaaagagtgtccac

SEQ ID NO: 1827 - DNA, 16 bp, Artificial sequence
  Synthetic Oligonucleotide
gaatagcaagctccaa

SEQ ID NO: 1828 - DNA, 16 bp, Artificial sequence
  Synthetic Oligonucleotide
catgataccacaccac

SEQ ID NO: 1829 - DNA, 16 bp, Artificial sequence
  Synthetic Oligonucleotide
gagcactcttattagc

SEQ ID NO: 1830 - DNA, 16 bp, Artificial sequence
  Synthetic Oligonucleotide
cctgttagagttggcc

SEQ ID NO: 1831 - DNA, 16 bp, Artificial sequence
  Synthetic Oligonucleotide
aggacactgtttccag

SEQ ID NO: 1832 - DNA, 16 bp, Artificial sequence
  Synthetic Oligonucleotide
gtcaccagaaccacat

SEQ ID NO: 1833 - DNA, 16 bp, Artificial sequence
  Synthetic Oligonucleotide
gtgtgcactttctggt

SEQ ID NO: 1834 - DNA, 16 bp, Artificial sequence
  Synthetic Oligonucleotide
ctctgattgggtcacc

SEQ ID NO: 1835 - DNA, 16 bp, Artificial sequence
  Synthetic Oligonucleotide
accaacaactcaggcc

SEQ ID NO: 1836 - DNA, 16 bp, Artificial sequence
  Synthetic Oligonucleotide
actctcaagctccacg

SEQ ID NO: 1837 - DNA, 16 bp, Artificial sequence
  Synthetic Oligonucleotide
ggacaatatgtctcct

SEQ ID NO: 1838 - DNA, 16 bp, Artificial sequence
  Synthetic Oligonucleotide
cattgtgctcaactga

SEQ ID NO: 1839 - DNA, 16 bp, Artificial sequence
  Synthetic Oligonucleotide
gcccatggtgaatctg

SEQ ID NO: 1840 - DNA, 16 bp, Artificial sequence
  Synthetic Oligonucleotide
cctagtacaaagtggc

SEQ ID NO: 1841 - DNA, 16 bp, Artificial sequence
  Synthetic Oligonucleotide
gccattttatccctga

SEQ ID NO: 1842 - DNA, 16 bp, Artificial sequence
  Synthetic Oligonucleotide
gggcccccatgtccat

SEQ ID NO: 1843 - DNA, 16 bp, Artificial sequence
  Synthetic Oligonucleotide
gttcttgcttatcctc

SEQ ID NO: 1844 - DNA, 16 bp, Artificial sequence
  Synthetic Oligonucleotide
atgtgacagtcaggga

SEQ ID NO: 1845 - DNA, 16 bp, Artificial sequence
  Synthetic Oligonucleotide
ttctgcaactgagcct

SEQ ID NO: 1846 - DNA, 16 bp, Artificial sequence
  Synthetic Oligonucleotide
aatggcaggtcctggc

SEQ ID NO: 1847 - DNA, 16 bp, Artificial sequence
  Synthetic Oligonucleotide
agacagttggtggttt

SEQ ID NO: 1848 - DNA, 16 bp, Artificial sequence
  Synthetic Oligonucleotide
gaggagttggtttagt

SEQ ID NO: 1849 - DNA, 16 bp, Artificial sequence
  Synthetic Oligonucleotide
tgaccacctctcgggt

SEQ ID NO: 1850 - DNA, 16 bp, Artificial sequence
  Synthetic Oligonucleotide
atttggccctgagccc

SEQ ID NO: 1851 - DNA, 16 bp, Artificial sequence
  Synthetic Oligonucleotide
gcctttgagggagtgg

SEQ ID NO: 1852 - DNA, 16 bp, Artificial sequence
  Synthetic Oligonucleotide
acaacctgtccattcc

SEQ ID NO: 1853 - DNA, 16 bp, Artificial sequence
  Synthetic Oligonucleotide
gttgtcaactgggacc

SEQ ID NO: 1854 - DNA, 16 bp, Artificial sequence
  Synthetic Oligonucleotide
ctgttcaggtagcaca

SEQ ID NO: 1855 - DNA, 16 bp, Artificial sequence
  Synthetic Oligonucleotide
ccgggaaagactgtct

SEQ ID NO: 1856 - DNA, 16 bp, Artificial sequence
  Synthetic Oligonucleotide
actgcaccccacatat

SEQ ID NO: 1857 - DNA, 16 bp, Artificial sequence
  Synthetic Oligonucleotide
cctcatctcagtatga

SEQ ID NO: 1858 - DNA, 16 bp, Artificial sequence
  Synthetic Oligonucleotide
gcacacagacttgccc

SEQ ID NO: 1859 - DNA, 16 bp, Artificial sequence
  Synthetic Oligonucleotide
ctgcatctggactatg

SEQ ID NO: 1860 - DNA, 16 bp, Artificial sequence
  Synthetic Oligonucleotide
agggaaattagaggca

SEQ ID NO: 1861 - DNA, 16 bp, Artificial sequence
  Synthetic Oligonucleotide
ctgttgcctgacatgc

SEQ ID NO: 1862 - DNA, 16 bp, Artificial sequence
  Synthetic Oligonucleotide
acataaattccccaca

SEQ ID NO: 1863 - DNA, 16 bp, Artificial sequence
  Synthetic Oligonucleotide
cccactgactgactac

SEQ ID NO: 1864 - DNA, 16 bp, Artificial sequence
  Synthetic Oligonucleotide
tcctgtgacagaacca

SEQ ID NO: 1865 - DNA, 16 bp, Artificial sequence
  Synthetic Oligonucleotide
ctacacctttctgcac

SEQ ID NO: 1866 - DNA, 16 bp, Artificial sequence
  Synthetic Oligonucleotide
ggtccttgaaccccgt

SEQ ID NO: 1867 - DNA, 16 bp, Artificial sequence
  Synthetic Oligonucleotide
agcagatctgggttgt

SEQ ID NO: 1868 - DNA, 16 bp, Artificial sequence
  Synthetic Oligonucleotide
gactagcttctactac

SEQ ID NO: 1869 - DNA, 16 bp, Artificial sequence
  Synthetic Oligonucleotide
acaatcccttagccca

SEQ ID NO: 1870 - DNA, 16 bp, Artificial sequence
  Synthetic Oligonucleotide
gatgaaatgtgcacct

SEQ ID NO: 1871 - DNA, 16 bp, Artificial sequence
  Synthetic Oligonucleotide
gactgtgctatccgct

SEQ ID NO: 1872 - DNA, 16 bp, Artificial sequence
  Synthetic Oligonucleotide
gctcactataggcccc

SEQ ID NO: 1873 - DNA, 16 bp, Artificial sequence
  Synthetic Oligonucleotide
tagcatcatgccacag

SEQ ID NO: 1874 - DNA, 16 bp, Artificial sequence
  Synthetic Oligonucleotide
gcacattaggaggtag

SEQ ID NO: 1875 - DNA, 16 bp, Artificial sequence
  Synthetic Oligonucleotide
taccgctgggtgcggt

SEQ ID NO: 1876 - DNA, 16 bp, Artificial sequence
  Synthetic Oligonucleotide
atgaaactgtggctcg

SEQ ID NO: 1877 - DNA, 16 bp, Artificial sequence
  Synthetic Oligonucleotide
acatgtgggatcagag

SEQ ID NO: 1878 - DNA, 16 bp, Artificial sequence
  Synthetic Oligonucleotide
gatgatcctcacatac

SEQ ID NO: 1879 - DNA, 16 bp, Artificial sequence
  Synthetic Oligonucleotide
tagaaccttcctccac

SEQ ID NO: 1880 - DNA, 16 bp, Artificial sequence
  Synthetic Oligonucleotide
ggaagacttccctctg

SEQ ID NO: 1881 - DNA, 16 bp, Artificial sequence
  Synthetic Oligonucleotide
tagtgataagagctgg

SEQ ID NO: 1882 - DNA, 16 bp, Artificial sequence
  Synthetic Oligonucleotide
ggcaactatgttctca

SEQ ID NO: 1883 - DNA, 16 bp, Artificial sequence
  Synthetic Oligonucleotide
ctaactccatcactgc

SEQ ID NO: 1884 - DNA, 16 bp, Artificial sequence
  Synthetic Oligonucleotide
tccccaatacttgctg

SEQ ID NO: 1885 - DNA, 16 bp, Artificial sequence
  Synthetic Oligonucleotide
gctgttctaagcgaga

SEQ ID NO: 1886 - DNA, 16 bp, Artificial sequence
  Synthetic Oligonucleotide
tgagtgatgccttcca

SEQ ID NO: 1887 - DNA, 16 bp, Artificial sequence
  Synthetic Oligonucleotide
tccagaatactgcccc

SEQ ID NO: 1888 - DNA, 16 bp, Artificial sequence
  Synthetic Oligonucleotide
gcgctaacctcataaa

SEQ ID NO: 1889 - DNA, 16 bp, Artificial sequence
  Synthetic Oligonucleotide
ctggaaacgagacaca

SEQ ID NO: 1890 - DNA, 16 bp, Artificial sequence
  Synthetic Oligonucleotide
gagagagatgttccct

SEQ ID NO: 1891 - DNA, 16 bp, Artificial sequence
  Synthetic Oligonucleotide
ctgctggttgagaatc

SEQ ID NO: 1892 - DNA, 16 bp, Artificial sequence
  Synthetic Oligonucleotide
atgtccccagtggaag

SEQ ID NO: 1893 - DNA, 16 bp, Artificial sequence
  Synthetic Oligonucleotide
gcatcctccctagttg

SEQ ID NO: 1894 - DNA, 16 bp, Artificial sequence
  Synthetic Oligonucleotide
tgttggtcagcattca

SEQ ID NO: 1895 - DNA, 16 bp, Artificial sequence
  Synthetic Oligonucleotide
gacgactgccctgtgc

SEQ ID NO: 1896 - DNA, 16 bp, Artificial sequence
  Synthetic Oligonucleotide
atttgggcctagtggt

SEQ ID NO: 1897 - DNA, 16 bp, Artificial sequence
  Synthetic Oligonucleotide
cctagtcctcaagttt

SEQ ID NO: 1898 - DNA, 16 bp, Artificial sequence
  Synthetic Oligonucleotide
caagacatcagtagct

SEQ ID NO: 1899 - DNA, 16 bp, Artificial sequence
  Synthetic Oligonucleotide
cttatcagtcccagtc

SEQ ID NO: 1900 - DNA, 16 bp, Artificial sequence
  Synthetic Oligonucleotide
gacaacccatcagttg

SEQ ID NO: 1901 - DNA, 16 bp, Artificial sequence
  Synthetic Oligonucleotide
cagcaggctcaaagtg

SEQ ID NO: 1902 - DNA, 16 bp, Artificial sequence
  Synthetic Oligonucleotide
tggctaagtcaggccc

SEQ ID NO: 1903 - DNA, 16 bp, Artificial sequence
  Synthetic Oligonucleotide
tgtactccacctcacg

SEQ ID NO: 1904 - DNA, 16 bp, Artificial sequence
  Synthetic Oligonucleotide
agcaagctaagtgagt

SEQ ID NO: 1905 - DNA, 16 bp, Artificial sequence
  Synthetic Oligonucleotide
gttcttgagtgtagag

SEQ ID NO: 1906 - DNA, 16 bp, Artificial sequence
  Synthetic Oligonucleotide
gtgttcatacggaagc

SEQ ID NO: 1907 - DNA, 16 bp, Artificial sequence
  Synthetic Oligonucleotide
gttgggatgcgactct

SEQ ID NO: 1908 - DNA, 16 bp, Artificial sequence
  Synthetic Oligonucleotide
acgaagtctctttcct

SEQ ID NO: 1909 - DNA, 16 bp, Artificial sequence
  Synthetic Oligonucleotide
cgatgagttgggcagg

SEQ ID NO: 1910 - DNA, 16 bp, Artificial sequence
  Synthetic Oligonucleotide
gatacctttccactcc

SEQ ID NO: 1911 - DNA, 16 bp, Artificial sequence
  Synthetic Oligonucleotide
tccccaagattatgtg

SEQ ID NO: 1912 - DNA, 16 bp, Artificial sequence
  Synthetic Oligonucleotide
gcacccttttcattga

SEQ ID NO: 1913 - DNA, 16 bp, Artificial sequence
  Synthetic Oligonucleotide
tcgacttctcctgtct

SEQ ID NO: 1914 - DNA, 16 bp, Artificial sequence
  Synthetic Oligonucleotide
gcctttgacctttcgc

SEQ ID NO: 1915 - DNA, 16 bp, Artificial sequence
  Synthetic Oligonucleotide
gtgtgctgaggtttgc

SEQ ID NO: 1916 - DNA, 16 bp, Artificial sequence
  Synthetic Oligonucleotide
gcaagatgcatgcagc

SEQ ID NO: 1917 - DNA, 16 bp, Artificial sequence
  Synthetic Oligonucleotide
atcgaactctgcttga

SEQ ID NO: 1918 - DNA, 16 bp, Artificial sequence
  Synthetic Oligonucleotide
gcccagttttggcaac

SEQ ID NO: 1919 - DNA, 16 bp, Artificial sequence
  Synthetic Oligonucleotide
cccactaccatttggg

SEQ ID NO: 1920 - DNA, 16 bp, Artificial sequence
  Synthetic Oligonucleotide
caactataacagtatc

SEQ ID NO: 1921 - DNA, 16 bp, Artificial sequence
  Synthetic Oligonucleotide
ctataccacggtaact

SEQ ID NO: 1922 - DNA, 16 bp, Artificial sequence
  Synthetic Oligonucleotide
cctatatcactgtaac

SEQ ID NO: 1923 - DNA, 16 bp, Artificial sequence
  Synthetic Oligonucleotide
acctatatcactgtaa

SEQ ID NO: 1924 - DNA, 16 bp, Artificial sequence
  Synthetic Oligonucleotide
tcactgtacctatatc

SEQ ID NO: 1925 - DNA, 16 bp, Artificial sequence
  Synthetic Oligonucleotide
gtcctataactatatc

SEQ ID NO: 1926 - DNA, 16 bp, Artificial sequence
  Synthetic Oligonucleotide
ctgtacctataactgt

SEQ ID NO: 1927 - DNA, 16 bp, Artificial sequence
  Synthetic Oligonucleotide
cgtcactgtacctata

SEQ ID NO: 1928 - DNA, 16 bp, Artificial sequence
  Synthetic Oligonucleotide
catcactgtacctata

SEQ ID NO: 1929 - DNA, 16 bp, Artificial sequence
  Synthetic Oligonucleotide
caacatcactgtacct

SEQ ID NO: 1930 - DNA, 16 bp, Artificial sequence
  Synthetic Oligonucleotide
ttccctacccctggta

SEQ ID NO: 1931 - DNA, 16 bp, Artificial sequence
  Synthetic Oligonucleotide
ggtggaatgtcatggc

SEQ ID NO: 1932 - DNA, 16 bp, Artificial sequence
  Synthetic Oligonucleotide
gcggaaaactggccgt

SEQ ID NO: 1933 - DNA, 16 bp, Artificial sequence
  Synthetic Oligonucleotide
cccaatacagggccag

SEQ ID NO: 1934 - DNA, 16 bp, Artificial sequence
  Synthetic Oligonucleotide
ccaaccttcccaatct

SEQ ID NO: 1935 - DNA, 16 bp, Artificial sequence
  Synthetic Oligonucleotide
gaaggtgtgctgtcgc

SEQ ID NO: 1936 - DNA, 16 bp, Artificial sequence
  Synthetic Oligonucleotide
atcgagtcctgcctcc

SEQ ID NO: 1937 - DNA, 16 bp, Artificial sequence
  Synthetic Oligonucleotide
gcaaatccttccagca

SEQ ID NO: 1938 - DNA, 16 bp, Artificial sequence
  Synthetic Oligonucleotide
gcacgagcttgcctgt

SEQ ID NO: 1939 - DNA, 16 bp, Artificial sequence
  Synthetic Oligonucleotide
gagccatccagggtgc

SEQ ID NO: 1940 - DNA, 16 bp, Artificial sequence
  Synthetic Oligonucleotide
aggccatttgatccga

SEQ ID NO: 1941 - DNA, 16 bp, Artificial sequence
  Synthetic Oligonucleotide
gccacgcccttagcag

SEQ ID NO: 1942 - DNA, 16 bp, Artificial sequence
  Synthetic Oligonucleotide
gttccctgaggaacgg

SEQ ID NO: 1943 - DNA, 16 bp, Artificial sequence
  Synthetic Oligonucleotide
ggcagttaggccagga

SEQ ID NO: 1944 - DNA, 16 bp, Artificial sequence
  Synthetic Oligonucleotide
ctacagatcatcccta

SEQ ID NO: 1945 - DNA, 16 bp, Artificial sequence
  Synthetic Oligonucleotide
ccccggagcaccttca

SEQ ID NO: 1946 - DNA, 16 bp, Artificial sequence
  Synthetic Oligonucleotide
gtgacccaagggtcga

SEQ ID NO: 1947 - DNA, 16 bp, Artificial sequence
  Synthetic Oligonucleotide
cgtggttagcctgaca

SEQ ID NO: 1948 - DNA, 16 bp, Artificial sequence
  Synthetic Oligonucleotide
tccatgtcagagttgc

SEQ ID NO: 1949 - DNA, 16 bp, Artificial sequence
  Synthetic Oligonucleotide
cctccttttggcttga

SEQ ID NO: 1950 - DNA, 16 bp, Artificial sequence
  Synthetic Oligonucleotide
ttccccagaggtgata

SEQ ID NO: 1951 - DNA, 16 bp, Artificial sequence
  Synthetic Oligonucleotide
tctggttagcctccga

SEQ ID NO: 1952 - DNA, 16 bp, Artificial sequence
  Synthetic Oligonucleotide
tggccaagcaaccagt

SEQ ID NO: 1953 - DNA, 16 bp, Artificial sequence
  Synthetic Oligonucleotide
gcccaatgtcctaacc

SEQ ID NO: 1954 - DNA, 16 bp, Artificial sequence
  Synthetic Oligonucleotide
ccaccgctgcccgcca

SEQ ID NO: 1955 - DNA, 16 bp, Artificial sequence
  Synthetic Oligonucleotide
tgtgaccccccaccgc

SEQ ID NO: 1956 - DNA, 16 bp, Artificial sequence
  Synthetic Oligonucleotide
ttgtgaccccccaccg

SEQ ID NO: 1957 - DNA, 16 bp, Artificial sequence
  Synthetic Oligonucleotide
actgaacccccttagg

SEQ ID NO: 1958 - DNA, 16 bp, Artificial sequence
  Synthetic Oligonucleotide
ccttcatacccctcac

SEQ ID NO: 1959 - DNA, 16 bp, Artificial sequence
  Synthetic Oligonucleotide
ccgataacagaccggc

SEQ ID NO: 1960 - DNA, 16 bp, Artificial sequence
  Synthetic Oligonucleotide
atacccggagtcagga

SEQ ID NO: 1961 - DNA, 16 bp, Artificial sequence
  Synthetic Oligonucleotide
attgctcaggccccct

SEQ ID NO: 1962 - DNA, 16 bp, Artificial sequence
  Synthetic Oligonucleotide
caagccactaacccac

SEQ ID NO: 1963 - DNA, 16 bp, Artificial sequence
  Synthetic Oligonucleotide
aattcttggaccaagg

SEQ ID NO: 1964 - DNA, 16 bp, Artificial sequence
  Synthetic Oligonucleotide
ccatctactcccccat

SEQ ID NO: 1965 - DNA, 16 bp, Artificial sequence
  Synthetic Oligonucleotide
gcagcgagcattccaa

SEQ ID NO: 1966 - DNA, 16 bp, Artificial sequence
  Synthetic Oligonucleotide
ggacaatgcctatgct

SEQ ID NO: 1967 - DNA, 16 bp, Artificial sequence
  Synthetic Oligonucleotide
gaagccattcactgca

SEQ ID NO: 1968 - DNA, 16 bp, Artificial sequence
  Synthetic Oligonucleotide
aaactcctctcaaggc

SEQ ID NO: 1969 - DNA, 16 bp, Artificial sequence
  Synthetic Oligonucleotide
gcaccaccatgcggtt

SEQ ID NO: 1970 - DNA, 16 bp, Artificial sequence
  Synthetic Oligonucleotide
tgcagggctgcgcagt

SEQ ID NO: 1971 - DNA, 16 bp, Artificial sequence
  Synthetic Oligonucleotide
ttagccactcctcttg

SEQ ID NO: 1972 - DNA, 16 bp, Artificial sequence
  Synthetic Oligonucleotide
agctagctgaccccaa

SEQ ID NO: 1973 - DNA, 16 bp, Artificial sequence
  Synthetic Oligonucleotide
tccgcctttggatact

SEQ ID NO: 1974 - DNA, 16 bp, Artificial sequence
  Synthetic Oligonucleotide
cctgctgattgtgtct

SEQ ID NO: 1975 - DNA, 16 bp, Artificial sequence
  Synthetic Oligonucleotide
tcgaggacagccccca

SEQ ID NO: 1976 - DNA, 16 bp, Artificial sequence
  Synthetic Oligonucleotide
acccgtcagcctcagc

SEQ ID NO: 1977 - DNA, 16 bp, Artificial sequence
  Synthetic Oligonucleotide
cttgcctattcacccc

SEQ ID NO: 1978 - DNA, 16 bp, Artificial sequence
  Synthetic Oligonucleotide
cggacaagccttacag

SEQ ID NO: 1979 - DNA, 16 bp, Artificial sequence
  Synthetic Oligonucleotide
cacacttaccccgctc

SEQ ID NO: 1980 - DNA, 16 bp, Artificial sequence
  Synthetic Oligonucleotide
cctccccttgtgtgtc

SEQ ID NO: 1981 - DNA, 16 bp, Artificial sequence
  Synthetic Oligonucleotide
ccgcttccctgactgt

SEQ ID NO: 1982 - DNA, 16 bp, Artificial sequence
  Synthetic Oligonucleotide
cagctcccttactagg

SEQ ID NO: 1983 - DNA, 16 bp, Artificial sequence
  Synthetic Oligonucleotide
aggtattgaccgccag

SEQ ID NO: 1984 - DNA, 16 bp, Artificial sequence
  Synthetic Oligonucleotide
ggtaaatccatcccct

SEQ ID NO: 1985 - DNA, 16 bp, Artificial sequence
  Synthetic Oligonucleotide
gcccgatcaccttaga

SEQ ID NO: 1986 - DNA, 16 bp, Artificial sequence
  Synthetic Oligonucleotide
gtctaactggcctggc

SEQ ID NO: 1987 - DNA, 16 bp, Artificial sequence
  Synthetic Oligonucleotide
ctaagctgtgtctcat

SEQ ID NO: 1988 - DNA, 16 bp, Artificial sequence
  Synthetic Oligonucleotide
tgtttcaagtgccaga

SEQ ID NO: 1989 - DNA, 16 bp, Artificial sequence
  Synthetic Oligonucleotide
tgcagtggtcaagcat

SEQ ID NO: 1990 - DNA, 16 bp, Artificial sequence
  Synthetic Oligonucleotide
gcgattccttgcctct

SEQ ID NO: 1991 - DNA, 16 bp, Artificial sequence
  Synthetic Oligonucleotide
ataatagaggcagcca

SEQ ID NO: 1992 - DNA, 16 bp, Artificial sequence
  Synthetic Oligonucleotide
gtcagaaggcctctta

SEQ ID NO: 1993 - DNA, 16 bp, Artificial sequence
  Synthetic Oligonucleotide
tatttatccgacctct

SEQ ID NO: 1994 - DNA, 16 bp, Artificial sequence
  Synthetic Oligonucleotide
gaggtggttggagcta

SEQ ID NO: 1995 - DNA, 16 bp, Artificial sequence
  Synthetic Oligonucleotide
cagatcccaattcttc

SEQ ID NO: 1996 - DNA, 16 bp, Artificial sequence
  Synthetic Oligonucleotide
gagtctttccaatcct

SEQ ID NO: 1997 - DNA, 16 bp, Artificial sequence
  Synthetic Oligonucleotide
tctcaatcccaacccc

SEQ ID NO: 1998 - DNA, 16 bp, Artificial sequence
  Synthetic Oligonucleotide
cctcaatcccaaccca

SEQ ID NO: 1999 - DNA, 16 bp, Artificial sequence
  Synthetic Oligonucleotide
tagtggcaagaaccac

SEQ ID NO: 2000 - DNA, 16 bp, Artificial sequence
  Synthetic Oligonucleotide
cgcgcgaatgcctgcc

SEQ ID NO: 2001 - DNA, 16 bp, Artificial sequence
  Synthetic Oligonucleotide
gacacctgcttgatta

SEQ ID NO: 2002 - DNA, 16 bp, Artificial sequence
  Synthetic Oligonucleotide
ggcactggtcatggac

SEQ ID NO: 2003 - DNA, 16 bp, Artificial sequence
  Synthetic Oligonucleotide
gcgccatccttcaatc

SEQ ID NO: 2004 - DNA, 16 bp, Artificial sequence
  Synthetic Oligonucleotide
gatccacccatgacct

SEQ ID NO: 2005 - DNA, 16 bp, Artificial sequence
  Synthetic Oligonucleotide
gctgtgactcagatca

SEQ ID NO: 2006 - DNA, 16 bp, Artificial sequence
  Synthetic Oligonucleotide
ctcttcgcatggacac

SEQ ID NO: 2007 - DNA, 16 bp, Artificial sequence
  Synthetic Oligonucleotide
gcccaagcctacatgc

SEQ ID NO: 2008 - DNA, 16 bp, Artificial sequence
  Synthetic Oligonucleotide
gtgcgattaagcccca

SEQ ID NO: 2009 - DNA, 16 bp, Artificial sequence
  Synthetic Oligonucleotide
gcttgtagaagggatt

SEQ ID NO: 2010 - DNA, 16 bp, Artificial sequence
  Synthetic Oligonucleotide
tgtgcaatcaggtgga

SEQ ID NO: 2011 - DNA, 16 bp, Artificial sequence
  Synthetic Oligonucleotide
ccggcctggatacagc

SEQ ID NO: 2012 - DNA, 16 bp, Artificial sequence
  Synthetic Oligonucleotide
cggccaatgggaaagg

SEQ ID NO: 2013 - DNA, 16 bp, Artificial sequence
  Synthetic Oligonucleotide
tggaggagtagggaat

SEQ ID NO: 2014 - DNA, 16 bp, Artificial sequence
  Synthetic Oligonucleotide
cccgaagagtcaagtc

SEQ ID NO: 2015 - DNA, 16 bp, Artificial sequence
  Synthetic Oligonucleotide
gtgctgcattgcatga

SEQ ID NO: 2016 - DNA, 16 bp, Artificial sequence
  Synthetic Oligonucleotide
acacgccaggtgaaaa

SEQ ID NO: 2017 - DNA, 16 bp, Artificial sequence
  Synthetic Oligonucleotide
atgcatgcctacccaa

SEQ ID NO: 2018 - DNA, 16 bp, Artificial sequence
  Synthetic Oligonucleotide
gttactctgtgatcca

SEQ ID NO: 2019 - DNA, 16 bp, Artificial sequence
  Synthetic Oligonucleotide
aacattgtgtagctgc

SEQ ID NO: 2020 - DNA, 16 bp, Artificial sequence
  Synthetic Oligonucleotide
gagactgaagccctca

SEQ ID NO: 2021 - DNA, 16 bp, Artificial sequence
  Synthetic Oligonucleotide
cactgcctagaaaggc

SEQ ID NO: 2022 - DNA, 16 bp, Artificial sequence
  Synthetic Oligonucleotide
tgtagtatccagagta

SEQ ID NO: 2023 - DNA, 16 bp, Artificial sequence
  Synthetic Oligonucleotide
agatgacctgcagatg

SEQ ID NO: 2024 - DNA, 16 bp, Artificial sequence
  Synthetic Oligonucleotide
aaaccatgaattaggt

SEQ ID NO: 2025 - DNA, 16 bp, Artificial sequence
  Synthetic Oligonucleotide
ttgctactttacacca

SEQ ID NO: 2026 - DNA, 16 bp, Artificial sequence
  Synthetic Oligonucleotide
ggcattaggataggca

SEQ ID NO: 2027 - DNA, 16 bp, Artificial sequence
  Synthetic Oligonucleotide
cactcagactgtctga

SEQ ID NO: 2028 - DNA, 16 bp, Artificial sequence
  Synthetic Oligonucleotide
agatccggaataacca

SEQ ID NO: 2029 - DNA, 16 bp, Artificial sequence
  Synthetic Oligonucleotide
attgacaaccatccta

SEQ ID NO: 2030 - DNA, 16 bp, Artificial sequence
  Synthetic Oligonucleotide
actcattggtctacag

SEQ ID NO: 2031 - DNA, 16 bp, Artificial sequence
  Synthetic Oligonucleotide
atgccttgtgcctatt

SEQ ID NO: 2032 - DNA, 16 bp, Artificial sequence
  Synthetic Oligonucleotide
actctgaggccttagg

SEQ ID NO: 2033 - DNA, 16 bp, Artificial sequence
  Synthetic Oligonucleotide
gcattactcagcatgt

SEQ ID NO: 2034 - DNA, 16 bp, Artificial sequence
  Synthetic Oligonucleotide
ccagtcaccaccattg

SEQ ID NO: 2035 - DNA, 16 bp, Artificial sequence
  Synthetic Oligonucleotide
ggtctaactctaaggg

SEQ ID NO: 2036 - DNA, 16 bp, Artificial sequence
  Synthetic Oligonucleotide
tgtcctttaaagtatc

SEQ ID NO: 2037 - DNA, 16 bp, Artificial sequence
  Synthetic Oligonucleotide
tcatgtggcaacctgt

SEQ ID NO: 2038 - DNA, 16 bp, Artificial sequence
  Synthetic Oligonucleotide
aatctgcacctggcag

SEQ ID NO: 2039 - DNA, 16 bp, Artificial sequence
  Synthetic Oligonucleotide
catggctattgcttcc

SEQ ID NO: 2040 - DNA, 16 bp, Artificial sequence
  Synthetic Oligonucleotide
gggctatattgccagc

SEQ ID NO: 2041 - DNA, 16 bp, Artificial sequence
  Synthetic Oligonucleotide
ccagagccttgatcag

SEQ ID NO: 2042 - DNA, 16 bp, Artificial sequence
  Synthetic Oligonucleotide
ggtgggttatctgaga

SEQ ID NO: 2043 - DNA, 16 bp, Artificial sequence
  Synthetic Oligonucleotide
tagctccatgctgtgt

SEQ ID NO: 2044 - DNA, 16 bp, Artificial sequence
  Synthetic Oligonucleotide
gggaatttatgctgcc

SEQ ID NO: 2045 - DNA, 16 bp, Artificial sequence
  Synthetic Oligonucleotide
tgatgaagttccacct

SEQ ID NO: 2046 - DNA, 16 bp, Artificial sequence
  Synthetic Oligonucleotide
taggcacagacaacct

SEQ ID NO: 2047 - DNA, 16 bp, Artificial sequence
  Synthetic Oligonucleotide
tccaactacaggactc

SEQ ID NO: 2048 - DNA, 16 bp, Artificial sequence
  Synthetic Oligonucleotide
ttctgggaaactctct

SEQ ID NO: 2049 - DNA, 16 bp, Artificial sequence
  Synthetic Oligonucleotide
agctcacacccaaaaa

SEQ ID NO: 2050 - DNA, 16 bp, Artificial sequence
  Synthetic Oligonucleotide
tctgttaccttgagga

SEQ ID NO: 2051 - DNA, 16 bp, Artificial sequence
  Synthetic Oligonucleotide
tggtcatgtcaactgt

SEQ ID NO: 2052 - DNA, 16 bp, Artificial sequence
  Synthetic Oligonucleotide
gtaagccttcacaggg

SEQ ID NO: 2053 - DNA, 16 bp, Artificial sequence
  Synthetic Oligonucleotide
ctcaccagagttgtcc

SEQ ID NO: 2054 - DNA, 16 bp, Artificial sequence
  Synthetic Oligonucleotide
catccctgacaggtcc

SEQ ID NO: 2055 - DNA, 16 bp, Artificial sequence
  Synthetic Oligonucleotide
cccttctaaccaagga

SEQ ID NO: 2056 - DNA, 16 bp, Artificial sequence
  Synthetic Oligonucleotide
ggatgagatgcatcca

SEQ ID NO: 2057 - DNA, 16 bp, Artificial sequence
  Synthetic Oligonucleotide
atggcggtgaagcagc

SEQ ID NO: 2058 - DNA, 16 bp, Artificial sequence
  Synthetic Oligonucleotide
tgaataccatccccgc

SEQ ID NO: 2059 - DNA, 16 bp, Artificial sequence
  Synthetic Oligonucleotide
gcgccatctgccctgt

SEQ ID NO: 2060 - DNA, 16 bp, Artificial sequence
  Synthetic Oligonucleotide
tgggttggaggagtgg

SEQ ID NO: 2061 - DNA, 16 bp, Artificial sequence
  Synthetic Oligonucleotide
tggtggtgggattggt

SEQ ID NO: 2062 - DNA, 16 bp, Artificial sequence
  Synthetic Oligonucleotide
ttggtggtgggattgg

SEQ ID NO: 2063 - DNA, 16 bp, Artificial sequence
  Synthetic Oligonucleotide
ggtggtggaattggtg

SEQ ID NO: 2064 - DNA, 16 bp, Artificial sequence
  Synthetic Oligonucleotide
gagattggtggtgggt

SEQ ID NO: 2065 - DNA, 16 bp, Artificial sequence
  Synthetic Oligonucleotide
gtggtgggattggtgc

SEQ ID NO: 2066 - DNA, 16 bp, Artificial sequence
  Synthetic Oligonucleotide
tggcgggattggtggt

SEQ ID NO: 2067 - DNA, 16 bp, Artificial sequence
  Synthetic Oligonucleotide
cggtggtgggattggt

SEQ ID NO: 2068 - DNA, 16 bp, Artificial sequence
  Synthetic Oligonucleotide
tcggtggtgggattgg

SEQ ID NO: 2069 - DNA, 16 bp, Artificial sequence
  Synthetic Oligonucleotide
atcggtggtgggattg

SEQ ID NO: 2070 - DNA, 16 bp, Artificial sequence
  Synthetic Oligonucleotide
gatcggtggtgggatt

SEQ ID NO: 2071 - DNA, 16 bp, Artificial sequence
  Synthetic Oligonucleotide
ggatcggtggtgggat

SEQ ID NO: 2072 - DNA, 16 bp, Artificial sequence
  Synthetic Oligonucleotide
gcgggatcggtggtgg

SEQ ID NO: 2073 - DNA, 16 bp, Artificial sequence
  Synthetic Oligonucleotide
ggcgggatcggtggtg

SEQ ID NO: 2074 - DNA, 16 bp, Artificial sequence
  Synthetic Oligonucleotide
gagcaaatacagtcca

SEQ ID NO: 2075 - DNA, 16 bp, Artificial sequence
  Synthetic Oligonucleotide
gtctcgatggcaagct

SEQ ID NO: 2076 - DNA, 16 bp, Artificial sequence
  Synthetic Oligonucleotide
ctcaccggtactctgc

SEQ ID NO: 2077 - DNA, 16 bp, Artificial sequence
  Synthetic Oligonucleotide
tcctggaggcaccaat

SEQ ID NO: 2078 - DNA, 16 bp, Artificial sequence
  Synthetic Oligonucleotide
agccctgtttggtttt

SEQ ID NO: 2079 - DNA, 16 bp, Artificial sequence
  Synthetic Oligonucleotide
tgaagggcgaggcgca

SEQ ID NO: 2080 - DNA, 16 bp, Artificial sequence
  Synthetic Oligonucleotide
aagaggatgtcaggct

SEQ ID NO: 2081 - DNA, 16 bp, Artificial sequence
  Synthetic Oligonucleotide
ttgaggaaagacctgc

SEQ ID NO: 2082 - DNA, 16 bp, Artificial sequence
  Synthetic Oligonucleotide
gctgagtgtgacttaa

SEQ ID NO: 2083 - DNA, 16 bp, Artificial sequence
  Synthetic Oligonucleotide
gtacatgactccagtg

SEQ ID NO: 2084 - DNA, 16 bp, Artificial sequence
  Synthetic Oligonucleotide
gtagagcatggagcga

SEQ ID NO: 2085 - DNA, 16 bp, Artificial sequence
  Synthetic Oligonucleotide
cgcttcaggaaagcga

SEQ ID NO: 2086 - DNA, 16 bp, Artificial sequence
  Synthetic Oligonucleotide
ggcaggagactccgtg

SEQ ID NO: 2087 - DNA, 16 bp, Artificial sequence
  Synthetic Oligonucleotide
atccttcccctcgcaa

SEQ ID NO: 2088 - DNA, 16 bp, Artificial sequence
  Synthetic Oligonucleotide
taatgagtgggttagg

SEQ ID NO: 2089 - DNA, 16 bp, Artificial sequence
  Synthetic Oligonucleotide
ggagcagtgcaggtaa

SEQ ID NO: 2090 - DNA, 16 bp, Artificial sequence
  Synthetic Oligonucleotide
ataggcaattgttcct

SEQ ID NO: 2091 - DNA, 16 bp, Artificial sequence
  Synthetic Oligonucleotide
agtcctacaattacca

SEQ ID NO: 2092 - DNA, 16 bp, Artificial sequence
  Synthetic Oligonucleotide
gggctcctattccacc

SEQ ID NO: 2093 - DNA, 16 bp, Artificial sequence
  Synthetic Oligonucleotide
gccagctatgggaaca

SEQ ID NO: 2094 - DNA, 16 bp, Artificial sequence
  Synthetic Oligonucleotide
ccccatctcgaagccc

SEQ ID NO: 2095 - DNA, 16 bp, Artificial sequence
  Synthetic Oligonucleotide
gagtacattgggccca

SEQ ID NO: 2096 - DNA, 16 bp, Artificial sequence
  Synthetic Oligonucleotide
gagccttccgcctctc

SEQ ID NO: 2097 - DNA, 16 bp, Artificial sequence
  Synthetic Oligonucleotide
cggaccttcatcttca

SEQ ID NO: 2098 - DNA, 16 bp, Artificial sequence
  Synthetic Oligonucleotide
tctagaggccgcctgc

SEQ ID NO: 2099 - DNA, 16 bp, Artificial sequence
  Synthetic Oligonucleotide
cctataactgctgctc

SEQ ID NO: 2100 - DNA, 16 bp, Artificial sequence
  Synthetic Oligonucleotide
gtatcactgtactagt

SEQ ID NO: 2101 - DNA, 16 bp, Artificial sequence
  Synthetic Oligonucleotide
agtatcactgtactag

SEQ ID NO: 2102 - DNA, 16 bp, Artificial sequence
  Synthetic Oligonucleotide
cagtatcactgtacta

SEQ ID NO: 2103 - DNA, 16 bp, Artificial sequence
  Synthetic Oligonucleotide
taacagtatcactgta

SEQ ID NO: 2104 - DNA, 16 bp, Artificial sequence
  Synthetic Oligonucleotide
ctaacagtatcactgt

SEQ ID NO: 2105 - DNA, 16 bp, Artificial sequence
  Synthetic Oligonucleotide
tctaacagtatcactg

SEQ ID NO: 2106 - DNA, 16 bp, Artificial sequence
  Synthetic Oligonucleotide
ataactctaacagtat

SEQ ID NO: 2107 - DNA, 16 bp, Artificial sequence
  Synthetic Oligonucleotide
ctataactctaacagt

SEQ ID NO: 2108 - DNA, 16 bp, Artificial sequence
  Synthetic Oligonucleotide
actgtcctataactct

SEQ ID NO: 2109 - DNA, 16 bp, Artificial sequence
  Synthetic Oligonucleotide
tatatcactgtcctat

SEQ ID NO: 2110 - DNA, 16 bp, Artificial sequence
  Synthetic Oligonucleotide
cctatatcactgtcct

SEQ ID NO: 2111 - DNA, 16 bp, Artificial sequence
  Synthetic Oligonucleotide
tcctatatcactgtcc

SEQ ID NO: 2112 - DNA, 16 bp, Artificial sequence
  Synthetic Oligonucleotide
cactgtcctatatcac

SEQ ID NO: 2113 - DNA, 16 bp, Artificial sequence
  Synthetic Oligonucleotide
gtatcactgtcctata

SEQ ID NO: 2114 - DNA, 16 bp, Artificial sequence
  Synthetic Oligonucleotide
agtatcactgtcctat

SEQ ID NO: 2115 - DNA, 16 bp, Artificial sequence
  Synthetic Oligonucleotide
cagtatcactgtccta

SEQ ID NO: 2116 - DNA, 16 bp, Artificial sequence
  Synthetic Oligonucleotide
aacagtatcactgtcc

SEQ ID NO: 2117 - DNA, 16 bp, Artificial sequence
  Synthetic Oligonucleotide
tataacagtatcactg

SEQ ID NO: 2118 - DNA, 16 bp, Artificial sequence
  Synthetic Oligonucleotide
ctataacagtatcact

SEQ ID NO: 2119 - DNA, 16 bp, Artificial sequence
  Synthetic Oligonucleotide
taactataacagtatc

SEQ ID NO: 2120 - DNA, 16 bp, Artificial sequence
  Synthetic Oligonucleotide
tataactataacagta

SEQ ID NO: 2121 - DNA, 16 bp, Artificial sequence
  Synthetic Oligonucleotide
cctataactataacag

SEQ ID NO: 2122 - DNA, 16 bp, Artificial sequence
  Synthetic Oligonucleotide
tacctataactctaac

SEQ ID NO: 2123 - DNA, 16 bp, Artificial sequence
  Synthetic Oligonucleotide
actgtacctataactc

SEQ ID NO: 2124 - DNA, 16 bp, Artificial sequence
  Synthetic Oligonucleotide
tatcactgtacctata

SEQ ID NO: 2125 - DNA, 16 bp, Artificial sequence
  Synthetic Oligonucleotide
acaatatcactgtacc

SEQ ID NO: 2126 - DNA, 16 bp, Artificial sequence
  Synthetic Oligonucleotide
aacaatatcactgtac

SEQ ID NO: 2127 - DNA, 16 bp, Artificial sequence
  Synthetic Oligonucleotide
atatcactgtacctgt

SEQ ID NO: 2128 - DNA, 16 bp, Artificial sequence
  Synthetic Oligonucleotide
tatatcactgtacctg

SEQ ID NO: 2129 - DNA, 16 bp, Artificial sequence
  Synthetic Oligonucleotide
ctatatcactgtacct

SEQ ID NO: 2130 - DNA, 16 bp, Artificial sequence
  Synthetic Oligonucleotide
cctatatcactgtacc

SEQ ID NO: 2131 - DNA, 16 bp, Artificial sequence
  Synthetic Oligonucleotide
cctataacagtatcac

SEQ ID NO: 2132 - DNA, 16 bp, Artificial sequence
  Synthetic Oligonucleotide
tcctataacagtatca

SEQ ID NO: 2133 - DNA, 16 bp, Artificial sequence
  Synthetic Oligonucleotide
ttcctataacagtatc

SEQ ID NO: 2134 - DNA, 16 bp, Artificial sequence
  Synthetic Oligonucleotide
gtttcctataacagta

SEQ ID NO: 2135 - DNA, 16 bp, Artificial sequence
  Synthetic Oligonucleotide
ctatgtcactgtacct

SEQ ID NO: 2136 - DNA, 16 bp, Artificial sequence
  Synthetic Oligonucleotide
cctatgtcactgtacc

SEQ ID NO: 2137 - DNA, 16 bp, Artificial sequence
  Synthetic Oligonucleotide
tcctatgtcactgtac

SEQ ID NO: 2138 - DNA, 16 bp, Artificial sequence
  Synthetic Oligonucleotide
cactgtcctatgtcac

SEQ ID NO: 2139 - DNA, 16 bp, Artificial sequence
  Synthetic Oligonucleotide
tcactgtcctatgtca

SEQ ID NO: 2140 - DNA, 16 bp, Artificial sequence
  Synthetic Oligonucleotide
atcactgtcctatgtc

SEQ ID NO: 2141 - DNA, 16 bp, Artificial sequence
  Synthetic Oligonucleotide
ctacctataactctaa

SEQ ID NO: 2142 - DNA, 16 bp, Artificial sequence
  Synthetic Oligonucleotide
gtcctataactataac

SEQ ID NO: 2143 - DNA, 16 bp, Artificial sequence
  Synthetic Oligonucleotide
tatatcactgtaccta

SEQ ID NO: 2144 - DNA, 16 bp, Artificial sequence
  Synthetic Oligonucleotide
tacctataacagtatc

SEQ ID NO: 2145 - DNA, 16 bp, Artificial sequence
  Synthetic Oligonucleotide
actgtacctataacag

SEQ ID NO: 2146 - DNA, 16 bp, Artificial sequence
  Synthetic Oligonucleotide
caccgtactagtttcc

SEQ ID NO: 2147 - DNA, 16 bp, Artificial sequence
  Synthetic Oligonucleotide
tataacagtatcaccg

SEQ ID NO: 2148 - DNA, 16 bp, Artificial sequence
  Synthetic Oligonucleotide
ctataacagtatcacc

SEQ ID NO: 2149 - DNA, 16 bp, Artificial sequence
  Synthetic Oligonucleotide
acctataactataaca

SEQ ID NO: 2150 - DNA, 16 bp, Artificial sequence
  Synthetic Oligonucleotide
tggcgggatcggtggt

SEQ ID NO: 2151 - DNA, 16 bp, Artificial sequence
  Synthetic Oligonucleotide
tggtggcgggatcggt

SEQ ID NO: 2152 - DNA, 16 bp, Artificial sequence
  Synthetic Oligonucleotide
ttggtggcgggatcgg

SEQ ID NO: 2153 - DNA, 16 bp, Artificial sequence
  Synthetic Oligonucleotide
attggtggcgggatcg

SEQ ID NO: 2154 - DNA, 16 bp, Artificial sequence
  Synthetic Oligonucleotide
gattggtggcgggatc

SEQ ID NO: 2155 - DNA, 16 bp, Artificial sequence
  Synthetic Oligonucleotide
gttggtggcgggatcg

SEQ ID NO: 2156 - DNA, 16 bp, Artificial sequence
  Synthetic Oligonucleotide
ggttggtggcgggatc

SEQ ID NO: 2157 - DNA, 16 bp, Artificial sequence
  Synthetic Oligonucleotide
tggttggtggcgggat

SEQ ID NO: 2158 - DNA, 16 bp, Artificial sequence
  Synthetic Oligonucleotide
gaacacatcagggatt

SEQ ID NO: 2159 - DNA, 16 bp, Artificial sequence
  Synthetic Oligonucleotide
tttctatgggcctgac

SEQ ID NO: 2160 - DNA, 16 bp, Artificial sequence
  Synthetic Oligonucleotide
gctgtcacttaagcca

SEQ ID NO: 2161 - DNA, 16 bp, Artificial sequence
  Synthetic Oligonucleotide
tctagggccacacctc

SEQ ID NO: 2162 - DNA, 16 bp, Artificial sequence
  Synthetic Oligonucleotide
gttctacacacagtac

SEQ ID NO: 2163 - DNA, 16 bp, Artificial sequence
  Synthetic Oligonucleotide
gcagtatgttcaatcc

SEQ ID NO: 2164 - DNA, 16 bp, Artificial sequence
  Synthetic Oligonucleotide
cccacatgtaccaccg

SEQ ID NO: 2165 - DNA, 16 bp, Artificial sequence
  Synthetic Oligonucleotide
gtatggcagagcccct

SEQ ID NO: 2166 - DNA, 16 bp, Artificial sequence
  Synthetic Oligonucleotide
cccatcttgggacttt

SEQ ID NO: 2167 - DNA, 16 bp, Artificial sequence
  Synthetic Oligonucleotide
tggtcccaaattggag

SEQ ID NO: 2168 - DNA, 16 bp, Artificial sequence
  Synthetic Oligonucleotide
ctcacaatactgagcc

SEQ ID NO: 2169 - DNA, 16 bp, Artificial sequence
  Synthetic Oligonucleotide
ggagatatcaggtgca

SEQ ID NO: 2170 - DNA, 16 bp, Artificial sequence
  Synthetic Oligonucleotide
caaggcatgtgtgcac

SEQ ID NO: 2171 - DNA, 16 bp, Artificial sequence
  Synthetic Oligonucleotide
gccttattctgtgcaa

SEQ ID NO: 2172 - DNA, 16 bp, Artificial sequence
  Synthetic Oligonucleotide
aggtgtggcgcgcgcc

SEQ ID NO: 2173 - DNA, 16 bp, Artificial sequence
  Synthetic Oligonucleotide
ctctatacagctgggc

SEQ ID NO: 2174 - DNA, 16 bp, Artificial sequence
  Synthetic Oligonucleotide
gctgatcttctaatgc

SEQ ID NO: 2175 - DNA, 16 bp, Artificial sequence
  Synthetic Oligonucleotide
cctcattgctccacta

SEQ ID NO: 2176 - DNA, 16 bp, Artificial sequence
  Synthetic Oligonucleotide
tgggaagaaactagca

SEQ ID NO: 2177 - DNA, 16 bp, Artificial sequence
  Synthetic Oligonucleotide
gaatgttgctgtccca

SEQ ID NO: 2178 - DNA, 16 bp, Artificial sequence
  Synthetic Oligonucleotide
gcatcatgcttactgc

SEQ ID NO: 2179 - DNA, 16 bp, Artificial sequence
  Synthetic Oligonucleotide
gcggcagtagtgaatc

SEQ ID NO: 2180 - DNA, 16 bp, Artificial sequence
  Synthetic Oligonucleotide
cctacctaattcctcc

SEQ ID NO: 2181 - DNA, 16 bp, Artificial sequence
  Synthetic Oligonucleotide
aactgggcagtccttc

SEQ ID NO: 2182 - DNA, 16 bp, Artificial sequence
  Synthetic Oligonucleotide
ccagcgcaattctgct

SEQ ID NO: 2183 - DNA, 16 bp, Artificial sequence
  Synthetic Oligonucleotide
cgtttccctcaactcc

SEQ ID NO: 2184 - DNA, 16 bp, Artificial sequence
  Synthetic Oligonucleotide
cacggcaagtcgcggg

SEQ ID NO: 2185 - DNA, 16 bp, Artificial sequence
  Synthetic Oligonucleotide
cagttgtatccctccc

SEQ ID NO: 2186 - DNA, 16 bp, Artificial sequence
  Synthetic Oligonucleotide
gcctctcagacggcac

SEQ ID NO: 2187 - DNA, 16 bp, Artificial sequence
  Synthetic Oligonucleotide
ctgatcccacttgccc

SEQ ID NO: 2188 - DNA, 16 bp, Artificial sequence
  Synthetic Oligonucleotide
agtctctttcctaccc

SEQ ID NO: 2189 - DNA, 16 bp, Artificial sequence
  Synthetic Oligonucleotide
ccacgatgctctggcc

SEQ ID NO: 2190 - DNA, 16 bp, Artificial sequence
  Synthetic Oligonucleotide
tcggctcctggcagca

SEQ ID NO: 2191 - DNA, 16 bp, Artificial sequence
  Synthetic Oligonucleotide
accattcctgaccatg

SEQ ID NO: 2192 - DNA, 16 bp, Artificial sequence
  Synthetic Oligonucleotide
cccgaggtcacataat

SEQ ID NO: 2193 - DNA, 16 bp, Artificial sequence
  Synthetic Oligonucleotide
ttacaacagacccagg

SEQ ID NO: 2194 - DNA, 16 bp, Artificial sequence
  Synthetic Oligonucleotide
agcagggtatcttcac

SEQ ID NO: 2195 - DNA, 16 bp, Artificial sequence
  Synthetic Oligonucleotide
gaagttcctgtgtctt

SEQ ID NO: 2196 - DNA, 16 bp, Artificial sequence
  Synthetic Oligonucleotide
ccaacctctaaggcta

SEQ ID NO: 2197 - DNA, 16 bp, Artificial sequence
  Synthetic Oligonucleotide
atgcttacctttctcc

SEQ ID NO: 2198 - DNA, 16 bp, Artificial sequence
  Synthetic Oligonucleotide
acgacccactccatgt

SEQ ID NO: 2199 - DNA, 16 bp, Artificial sequence
  Synthetic Oligonucleotide
tgcttaaaagtctccc

SEQ ID NO: 2200 - DNA, 16 bp, Artificial sequence
  Synthetic Oligonucleotide
gccctagaagggccca

SEQ ID NO: 2201 - DNA, 16 bp, Artificial sequence
  Synthetic Oligonucleotide
gcgggtggtcttgcac

SEQ ID NO: 2202 - DNA, 16 bp, Artificial sequence
  Synthetic Oligonucleotide
gctcccggccattagc

SEQ ID NO: 2203 - DNA, 16 bp, Artificial sequence
  Synthetic Oligonucleotide
tctccatagtgagacg

SEQ ID NO: 2204 - DNA, 16 bp, Artificial sequence
  Synthetic Oligonucleotide
tggcaagctaccttct

SEQ ID NO: 2205 - DNA, 16 bp, Artificial sequence
  Synthetic Oligonucleotide
gggagctttcatggct

SEQ ID NO: 2206 - DNA, 16 bp, Artificial sequence
  Synthetic Oligonucleotide
aatgcaggccagcatc

SEQ ID NO: 2207 - DNA, 16 bp, Artificial sequence
  Synthetic Oligonucleotide
gaaaagccctccgagc

SEQ ID NO: 2208 - DNA, 16 bp, Artificial sequence
  Synthetic Oligonucleotide
caacaatccaaagcct

SEQ ID NO: 2209 - DNA, 16 bp, Artificial sequence
  Synthetic Oligonucleotide
ccccccagaaatccca

SEQ ID NO: 2210 - DNA, 16 bp, Artificial sequence
  Synthetic Oligonucleotide
gaccttgcttccatgt

SEQ ID NO: 2211 - DNA, 16 bp, Artificial sequence
  Synthetic Oligonucleotide
gagagacggcaccctg

SEQ ID NO: 2212 - DNA, 16 bp, Artificial sequence
  Synthetic Oligonucleotide
gggaaggtagtgttac

SEQ ID NO: 2213 - DNA, 16 bp, Artificial sequence
  Synthetic Oligonucleotide
gtgaatcagagcagtg

SEQ ID NO: 2214 - DNA, 16 bp, Artificial sequence
  Synthetic Oligonucleotide
tcacctgtgagtaacc

SEQ ID NO: 2215 - DNA, 16 bp, Artificial sequence
  Synthetic Oligonucleotide
gagttaccttacaagc

SEQ ID NO: 2216 - DNA, 16 bp, Artificial sequence
  Synthetic Oligonucleotide
tctcaagcagcctatt

SEQ ID NO: 2217 - DNA, 16 bp, Artificial sequence
  Synthetic Oligonucleotide
gcccctcttaaatagc

SEQ ID NO: 2218 - DNA, 16 bp, Artificial sequence
  Synthetic Oligonucleotide
gatatcatcatcccaa

SEQ ID NO: 2219 - DNA, 16 bp, Artificial sequence
  Synthetic Oligonucleotide
gtatccccttttctat

SEQ ID NO: 2220 - DNA, 16 bp, Artificial sequence
  Synthetic Oligonucleotide
agtatctcatgtgcct

SEQ ID NO: 2221 - DNA, 16 bp, Artificial sequence
  Synthetic Oligonucleotide
caagaccttgcttgcc

SEQ ID NO: 2222 - DNA, 16 bp, Artificial sequence
  Synthetic Oligonucleotide
tagtccactacacagc

SEQ ID NO: 2223 - DNA, 16 bp, Artificial sequence
  Synthetic Oligonucleotide
acgacaatgggattca

SEQ ID NO: 2224 - DNA, 16 bp, Artificial sequence
  Synthetic Oligonucleotide
gaatctccctgagtca

SEQ ID NO: 2225 - DNA, 16 bp, Artificial sequence
  Synthetic Oligonucleotide
tagagggatcccagga

SEQ ID NO: 2226 - DNA, 16 bp, Artificial sequence
  Synthetic Oligonucleotide
ccaggtgcagcacgga

SEQ ID NO: 2227 - DNA, 27 bp, Artificial sequence
  Synthetic Oligonucleotide
gcgtttgctcttcttcttgcgtttttt

SEQ ID NO: 2228 - DNA, 21 bp, Artificial sequence
  Primer
tgcctgctgttcagctttctc

SEQ ID NO: 2229 - DNA, 21 bp, Artificial sequence
  Primer
tggcaaagtccctgtaatgct

SEQ ID NO: 2230 - DNA, 30 bp, Artificial sequence
  Probe
cgtgactccacccaaagagacaaataaacg

SEQ ID NO: 2231 - DNA, 27 bp, Artificial sequence
  Primer
acaagtgcattttacagaccagagtac

SEQ ID NO: 2232 - DNA, 22 bp, Artificial sequence
  Primer
ggttgtccgctgactttatgct

SEQ ID NO: 2233 - DNA, 24 bp, Artificial sequence
  Probe
aagcacagtgcaagcggaacaccc

SEQ ID NO: 2234 - DNA, 21 bp, Artificial sequence
  Primer
gagtcccccagagcctacagt

SEQ ID NO: 2235 - DNA, 26 bp, Artificial sequence
  Primer
tgtcatttgttattgtgatggctaca

SEQ ID NO: 2236 - DNA, 25 bp, Artificial sequence
  Probe
ctgccctctacctggccaacaacca

SEQ ID NO: 2237 - DNA, 27 bp, Artificial sequence
  Primer
acaagtgcattttacagaccagagtac

SEQ ID NO: 2238 - DNA, 22 bp, Artificial sequence
  Primer
ggttgtccgctgactttatgct

SEQ ID NO: 2239 - DNA, 24 bp, Artificial sequence
  Probe
aagcacagtgcaagcggaacaccc

SEQ ID NO: 2240 - DNA, 25 bp, Artificial sequence
  Primer
agacccatttcctcaaggtagaact

SEQ ID NO: 2241 - DNA, 16 bp, Artificial sequence
  Primer
cgcagcgacgctcatg

SEQ ID NO: 2242 - DNA, 25 bp, Artificial sequence
  Probe
tctttgggtccagtggcaccctctt

SEQ ID NO: 2243 - DNA, 1837 bp, mus musculus
actgattctctgcgactgtctgctcagtctgtcctgaagctgcctagtgaccaagaacttggaccaggacgcagctgacatcgctgcccagatggcctccaggctgaccccactgaccctcctgctgctgctgctggctggggatagagccttctcagatcccgaagctaccagccacagcacccaggatccactggaggctcaagcgaaaagcagagagagcttccctgaaagagatgactcctggagtcccccagagcctacagtactgccctctacctggccaacaaccagtgtagccatcacaataacaaatgacaccatgggtaaagtagccaacgagtccttcagccagcacagccagccagctgctcagctacccacagattctccaggacagccccctctgaattcttccagccagccctccactgcctcagatcttcccacccaggctactactgaacccttctgcccggagccgcttgctcagtgctctgattcagacagagactcctcagaggcaaagctctcagaggctttgacagatttctctgtgaagctctaccacgccttctcagctaccaagatggctaagaccaacatggccttttccccattcagcattgccagcctcctcacacaggttcttcttggggctggagacagcaccaagagcaacttggagagcatcctttcctaccccaaggattttgcctgtgtccaccaagcactaaagggcttttcatccaaaggtgtcacttctgtgtctcagattttccacagcccagatctggccataagggacacctatgtgaatgcatctcagagcctgtatggaagcagccccagagtcctgggcccagacagtgctgctaacttagaactcatcaacacctgggtggctgagaacaccaaccataagatccgcaagctgctggacagcctgccttctgacacctgcctcgtccttctcaatgctgtctacttgagtgccaagtggaagataacatttgaaccaaaaaagatgatggcgcctttcttctacaaaaactctatgattaaagtgcccatgatgagtagcgtaaagtaccctgtggcccaattcgatgaccatactttgaaggccaaggtgggacagctgcagctctctcacaacctgagctttgtgatcgtggtacccgtgttcccaaagcaccaacttaaagatgtagaaaaggctctcaaccccactgtcttcaaggccatcatgaagaagctggagctgtccaaattcctgcccacttacctgacgatgcctcatataaaagtaaagagcagccaagacatgctgtcagtcatggagaaactggaattctttgacttcacttacgatctcaacctgtgcgggctgaccgaggacccagatcttcaggtgtctgccatgaaacacgagacagtgctggaactgacagagtcaggggtggaagcagctgcagcctctgccatctcctttggccgaagcttacccatctttgaggtgcagcgacctttcctcttcctgctctgggaccagcaacacaggttcccagtcttcatgggtcgtgtatatgaccccaggggttgagacaggcttgggtaaacattgtcacccaagcttcagctcctccggttatttccttgccactgcctgcccgagccacttcaagccttaggaactggcagacggaactgtttccatccaccaacccccagggtatcaaccacttttttgcagcttttacggttcaaacctatcaaactctacaaataaaacttgcagacattttcttctctcactaaaaaaaaaaaaaaaaaa

SEQ ID NO: 2244 - DNA, 20 bp, Artificial sequence
  Synthetic Oligonucleotide
ggcatattggtttttggaat

SEQ ID NO: 2245 - DNA, 20 bp, Artificial sequence
  Synthetic Oligonucleotide
aaagtggttgataccctggg

SEQ ID NO: 2246 - DNA, 20 bp, Artificial sequence
  Synthetic Oligonucleotide
ccttccctgaaggttcctcc

SEQ ID NO: 2247 - DNA, 20 bp, Artificial sequence
  Synthetic Oligonucleotide
gcatgggacagagatggtgc

SEQ ID NO: 2248 - DNA, 20 bp, Artificial sequence
  Synthetic Oligonucleotide
agcttcttgtccagctttat

SEQ ID NO: 2249 - DNA, 21 bp, Artificial sequence
  Synthetic Oligonucleotide
agcttcttgtccagctttata

SEQ ID NO: 2250 - DNA, 14 bp, Artificial sequence
  Synthetic Oligonucleotide
tcagtcatgacttc

SEQ ID NO: 2251 - DNA, 15 bp, Artificial sequence
  Synthetic Oligonucleotide
tcagtcatgacttca

SEQ ID NO: 2252 - DNA, 20 bp, Artificial sequence
  Synthetic Oligonucleotide
gctgattagagagaggtccc

SEQ ID NO: 2253 - DNA, 20 bp, Artificial sequence
  Synthetic Oligonucleotide
tcccatttcaggagacctgg

SEQ ID NO: 2254 - DNA, 15 bp, Artificial sequence
  Synthetic Oligonucleotide
atcagtcatgacttc

SEQ ID NO: 2255 - DNA, 20 bp, Artificial sequence
  Synthetic Oligonucleotide
cggtgcaaggcttaggaatt

SEQ ID NO: 2256 - DNA, 20 bp, Artificial sequence
  Synthetic Oligonucleotide
gcttcagtcatgacttcctt

SEQ ID NO: 2257 - DNA, 21 bp, Artificial sequence
  Synthetic Oligonucleotide
gcttcagtcatgacttcctta

SEQ ID NO: 2258 - DNA, 21 bp, Artificial sequence
  Synthetic Oligonucleotide
agcttcagtcatgacttcctt

SEQ ID NO: 2259 - DNA, 20 bp, Artificial sequence
  Synthetic Oligonucleotide
tggtaatccactttcagagg

SEQ ID NO: 2260 - DNA, 21 bp, Artificial sequence
  Synthetic Oligonucleotide
tggtaatccactttcagagga

SEQ ID NO: 2261 - DNA, 21 bp, Artificial sequence
  Synthetic Oligonucleotide
tgcttcagtcatgacttcctt

SEQ ID NO: 2262 - DNA, 20 bp, Artificial sequence
  Synthetic Oligonucleotide
cactgatttttgcccaggat

SEQ ID NO: 2263 - DNA, 21 bp, Artificial sequence
  Synthetic Oligonucleotide
cactgatttttgcccaggata

SEQ ID NO: 2264 - DNA, 21 bp, Artificial sequence
  Synthetic Oligonucleotide
aagcttcttgtccagctttat

SEQ ID NO: 2265 - DNA, 20 bp, Artificial sequence
  Synthetic Oligonucleotide
acccaattcagaaggaagga

SEQ ID NO: 2266 - DNA, 21 bp, Artificial sequence
  Synthetic Oligonucleotide
acccaattcagaaggaaggaa

SEQ ID NO: 2267 - DNA, 21 bp, Artificial sequence
  Synthetic Oligonucleotide
aacccaattcagaaggaagga

SEQ ID NO: 2268 - DNA, 21 bp, Artificial sequence
  Synthetic Oligonucleotide
atggtaatccactttcagagg

SEQ ID NO: 2269 - DNA, 20 bp, Artificial sequence
  Synthetic Oligonucleotide
tcttggttacatgaaatccc

SEQ ID NO: 2270 - DNA, 21 bp, Artificial sequence
  Synthetic Oligonucleotide
tcttggttacatgaaatccca

SEQ ID NO: 2271 - DNA, 20 bp, Artificial sequence
  Synthetic Oligonucleotide
attcactttcataatgctgg

SEQ ID NO: 2272 - DNA, 21 bp, Artificial sequence
  Synthetic Oligonucleotide
attcactttcataatgctgga

SEQ ID NO: 2273 - DNA, 21 bp, Artificial sequence
  Synthetic Oligonucleotide
atcttggttacatgaaatccc

SEQ ID NO: 2274 - DNA, 20 bp, Artificial sequence
  Synthetic Oligonucleotide
atgcatggtgatgcttctga

SEQ ID NO: 2275 - DNA, 20 bp, Artificial sequence
  Synthetic Oligonucleotide
cagctttattagggacagca

SEQ ID NO: 2276 - DNA, 21 bp, Artificial sequence
  Synthetic Oligonucleotide
cagctttattagggacagcaa

SEQ ID NO: 2277 - DNA, 21 bp, Artificial sequence
  Synthetic Oligonucleotide
acagctttattagggacagca

SEQ ID NO: 2278 - DNA, 16 bp, Artificial sequence
  Synthetic Oligonucleotide
ttcagtcatgacttcc

SEQ ID NO: 2279 - DNA, 18 bp, Artificial sequence
  Synthetic Oligonucleotide
  misc_feature (1)..(4): Bases at these positions are RNA
  misc_feature (15)..(18): Bases at these positions are RNA
gcuucagtcatgactucc

SEQ ID NO: 2280 - DNA, 21 bp, Artificial sequence
  Synthetic Oligonucleotide
tgctccgttggtgcttgttca

SEQ ID NO: 2281 - DNA, 20 bp, Artificial sequence
  Synthetic Oligonucleotide
tgctccgttggtgcttgttc

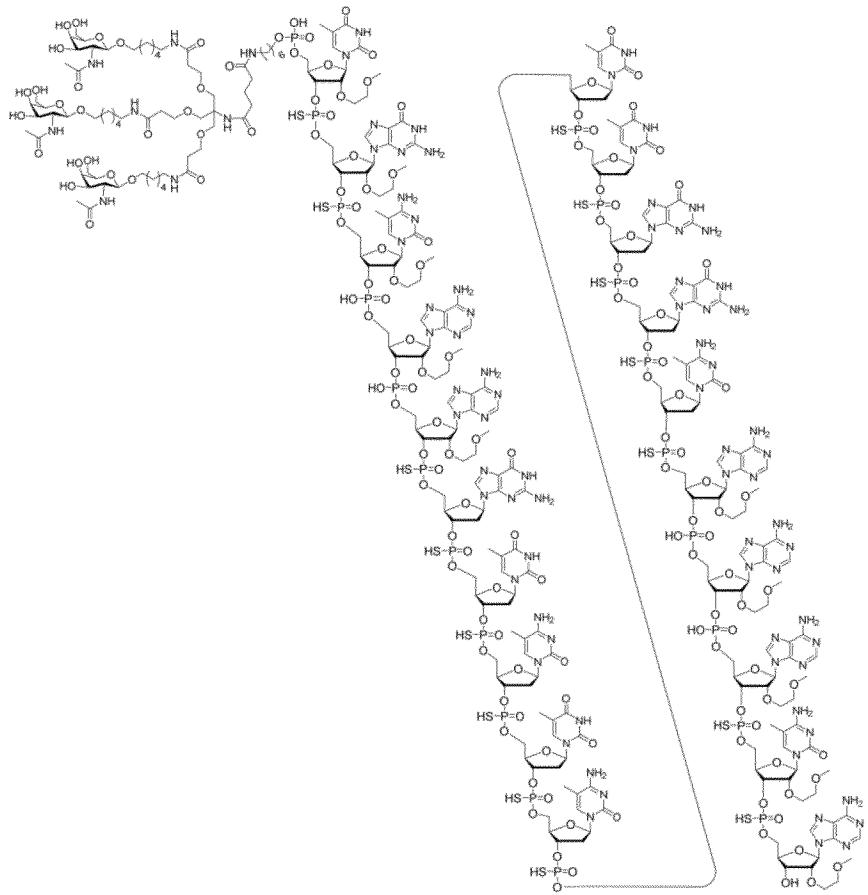

In Claim 14, Columns 719-720, the structure should read:
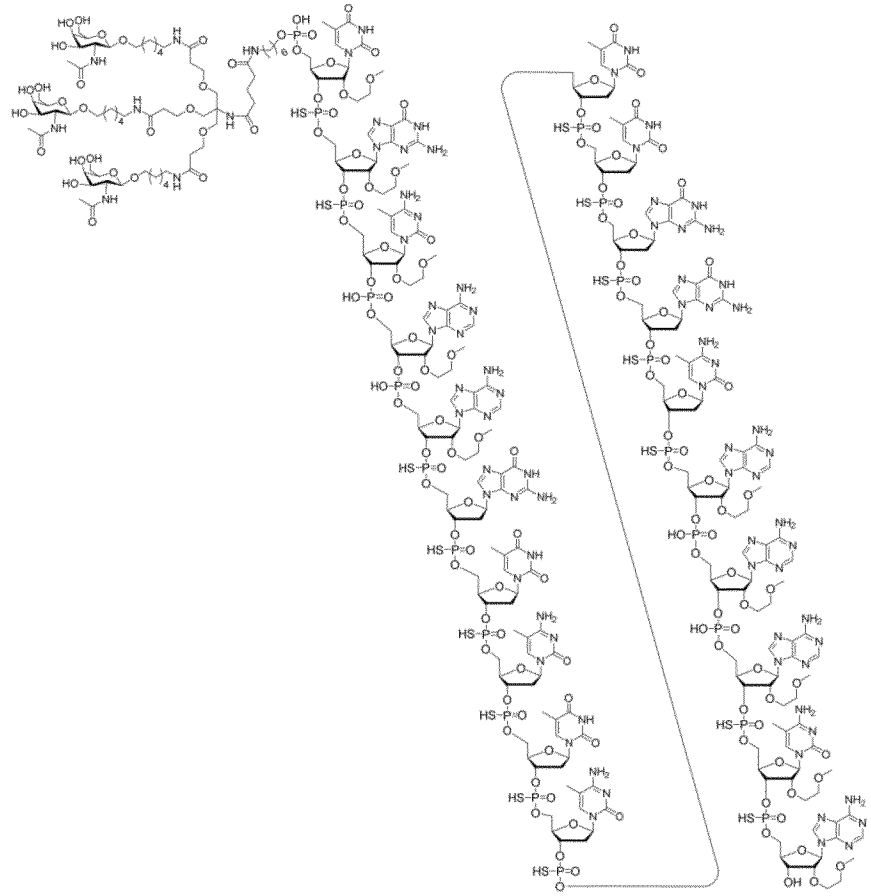

What is claimed:

1. A compound comprising a modified oligonucleotide and a conjugate group, wherein the modified oligonucleotide consists of 20 linked nucleosides and has the nucleobase sequence of SEQ ID NO: 570, wherein the modified oligonucleotide comprises at least 1 phosphodiester internucleoside linkage, and wherein the conjugate group is covalently linked to the modified oligonucleotide at the 5' end of the modified oligonucleotide, and wherein the conjugate group comprises:

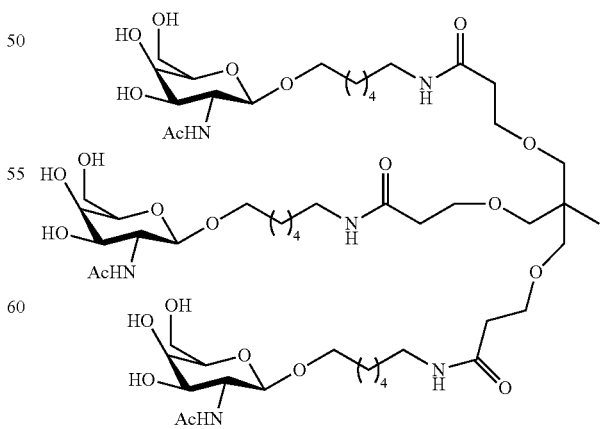

-continued

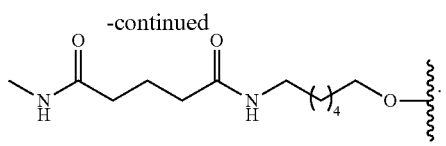

2. The compound of claim 1, wherein the compound consists of the modified oligonucleotide and the conjugate group, and wherein the modified oligonucleotide is single-stranded.

3. The compound of claim 1, wherein at least one internucleoside linkage of the modified oligonucleotide is a modified internucleoside linkage.

4. The compound of claim 3, wherein the at least one modified internucleoside linkage is a phosphorothioate internucleoside linkage.

5. The compound of claim 1, wherein the modified oligonucleotide comprises at least 2 phosphodiester internucleoside linkages.

6. The compound of claim 1, wherein the modified oligonucleotide comprises at least 3 phosphodiester internucleoside linkages.

7. The compound of claim 1, wherein the modified oligonucleotide comprises at least 4 phosphodiester internucleoside linkages.

8. The compound of claim 1, wherein each internucleoside linkage of the modified oligonucleotide is selected from a phosphodiester internucleoside linkage and a phosphorothioate internucleoside linkage.

9. The compound of claim 1, wherein at least one nucleoside of the modified oligonucleotide comprises a modified nucleobase, and wherein the at least one modified nucleobase is a 5-methylcytosine.

10. The compound of claim 1, wherein the modified oligonucleotide comprises at least one modified sugar.

11. The compound of claim 10, wherein the modified sugar is any of a 2'-O-methoxyethyl, 2'-O-methyl, a constrained ethyl, a LNA, or a 3'-fluoro-HNA.

12. The compound of claim 1, wherein the modified oligonucleotide comprises:
a gap segment consisting of 10 linked deoxynucleosides;
a 5' wing segment consisting of 5 linked nucleosides; and
a 3' wing segment consisting of 5 linked nucleosides;
wherein the gap segment is positioned between the 5' wing segment and the 3' wing segment and wherein each nucleoside of each wing segment comprises a modified sugar.

13. A modified oligonucleotide according to the following formula:

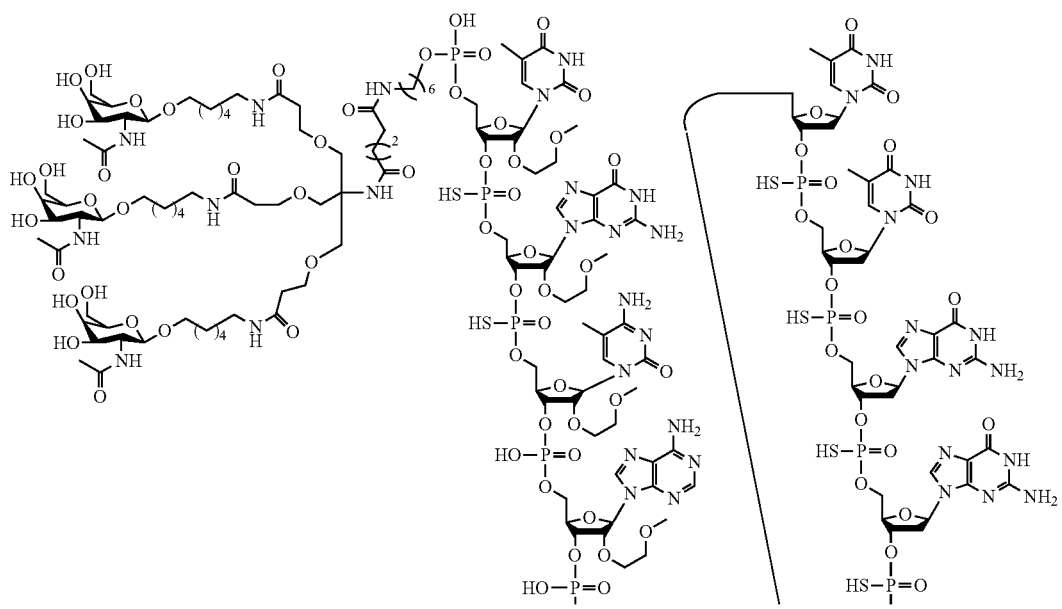

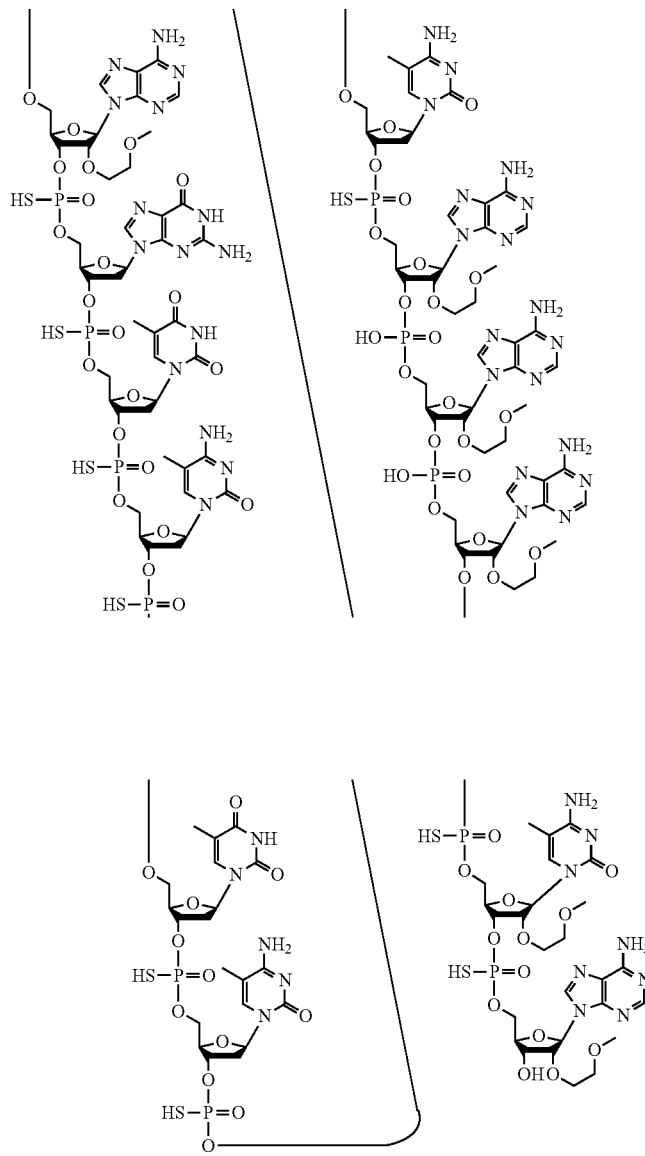
(SEQ ID NO: 570).
14. A composition comprising a modified oligonucleotide of the following formula:

719 720
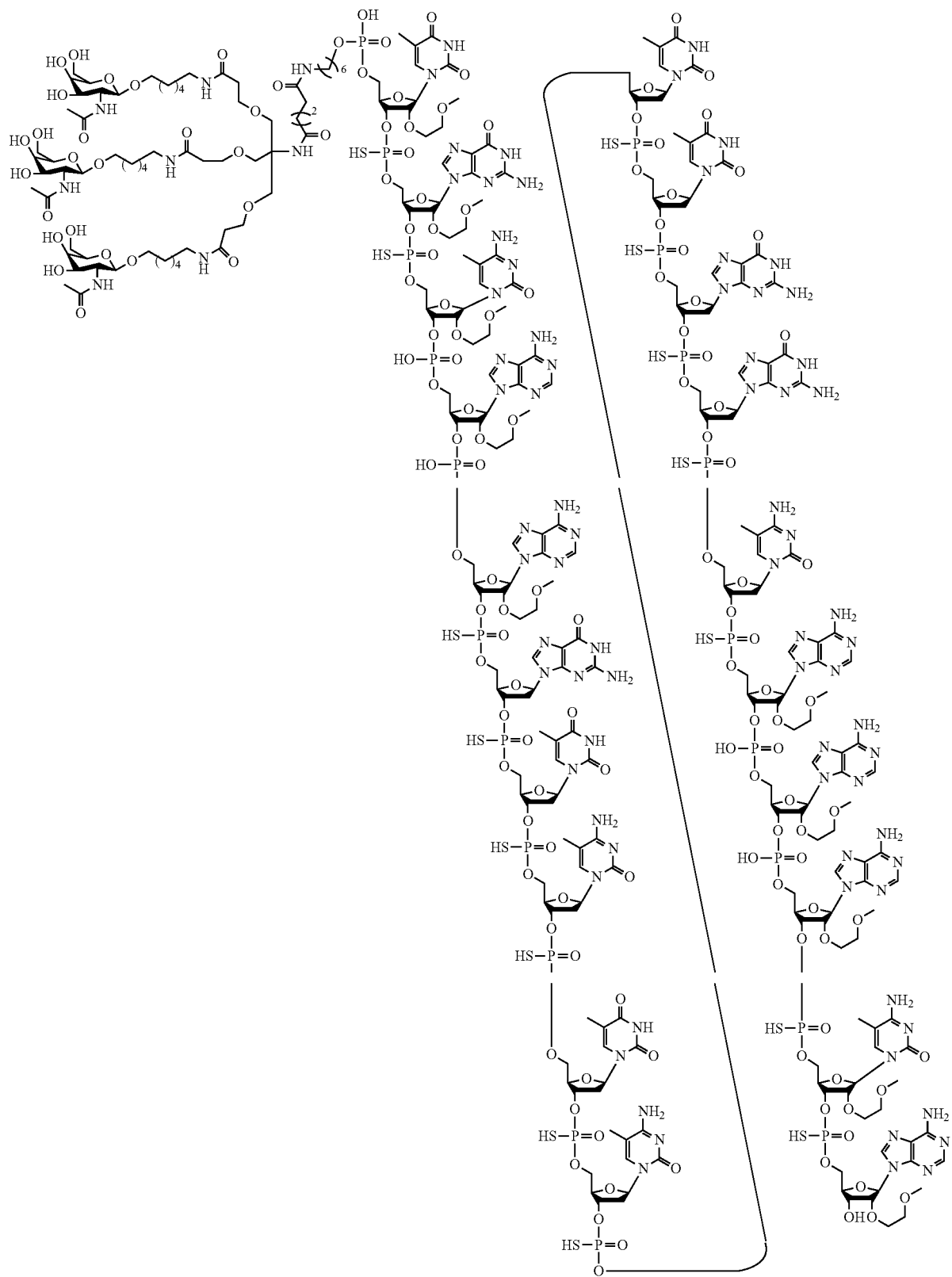

(SEQ ID NO: 570) and a pharmaceutically acceptable carrier or diluent.

15. A composition comprising the compound of claim 1 and at least one of a pharmaceutically acceptable carrier or diluent.

16. A method comprising administering to an animal the compound of claim 1, wherein the animal is a human.

17. The method of claim 16, wherein administering the compound prevents, treats, or ameliorates a PKK associated disease, disorder or condition.

18. The compound of claim 8, wherein the modified oligonucleotide comprises four phosphodiester internucleoside linkages and 15 phosphorothioate internucleoside linkages.

19. The modified oligonucleotide of claim 13, which is a salt of the formula.

20. The composition of claim 14, wherein the pharmaceutically acceptable carrier or diluent is phosphate-buffered saline (PBS).

21. The composition of claim 14, wherein the composition consists essentially of the modified oligonucleotide and PBS.

\* \* \* \* \*

UNITED STATES PATENT AND TRADEMARK OFFICE
CERTIFICATE OF CORRECTION

PATENT NO. : 10,294,477 B2
APPLICATION NO. : 15/308027
DATED : May 21, 2019
INVENTOR(S) : Eric E. Swayze Page 1 of 6

It is certified that error appears in the above-identified patent and that said Letters Patent is hereby corrected as shown below:

In the Specification

At Column 35, Line 1, through Column 36, Line 65, the structure should read:

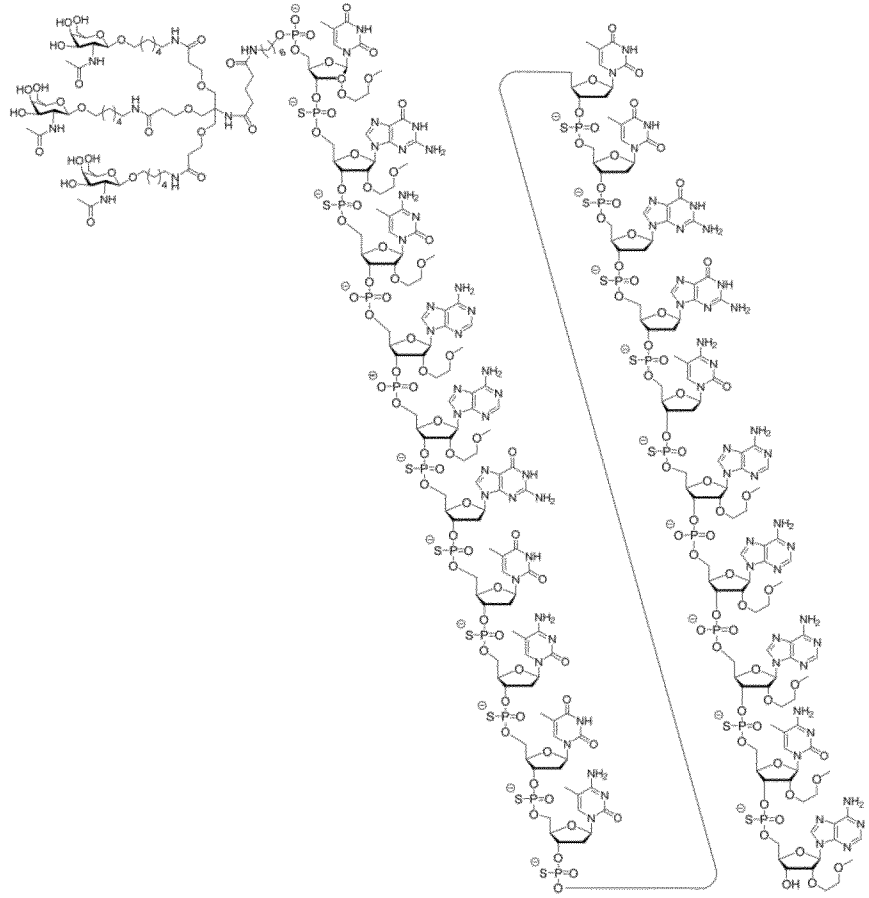

Signed and Sealed this
Thirteenth Day of September, 2022

Katherine Kelly Vidal
*Director of the United States Patent and Trademark Office*

CERTIFICATE OF CORRECTION (continued)
U.S. Pat. No. 10,294,477 B2

At Column 41, Line 3, through Column 42, the structure should read:

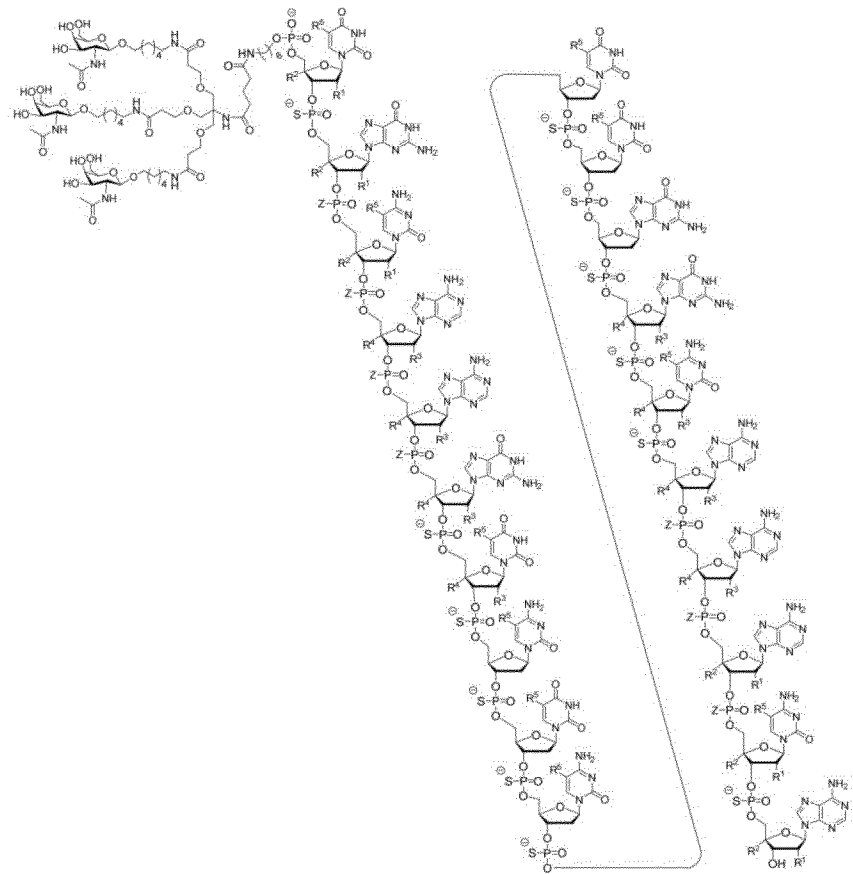

CERTIFICATE OF CORRECTION (continued)
U.S. Pat. No. 10,294,477 B2

At Column 159, Line 3, through Column 160, the structure should read:

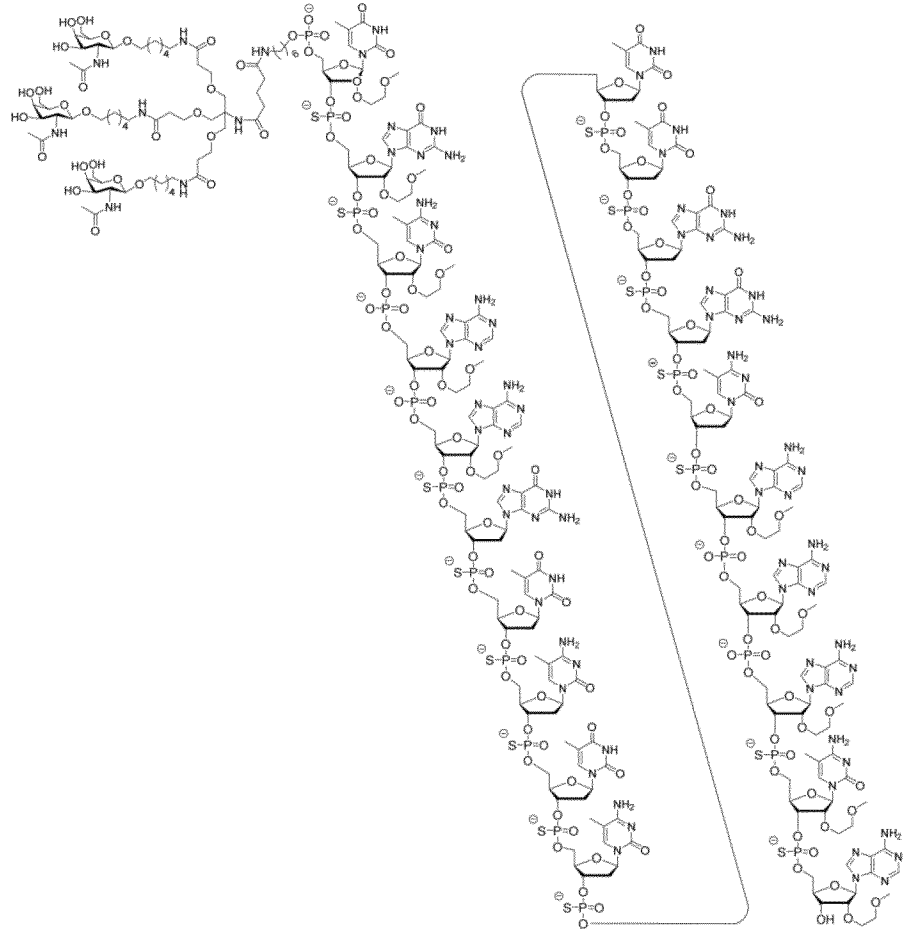

CERTIFICATE OF CORRECTION (continued)
U.S. Pat. No. 10,294,477 B2

In the Claims

In Claim 1, Columns 714-715, the structure should read:

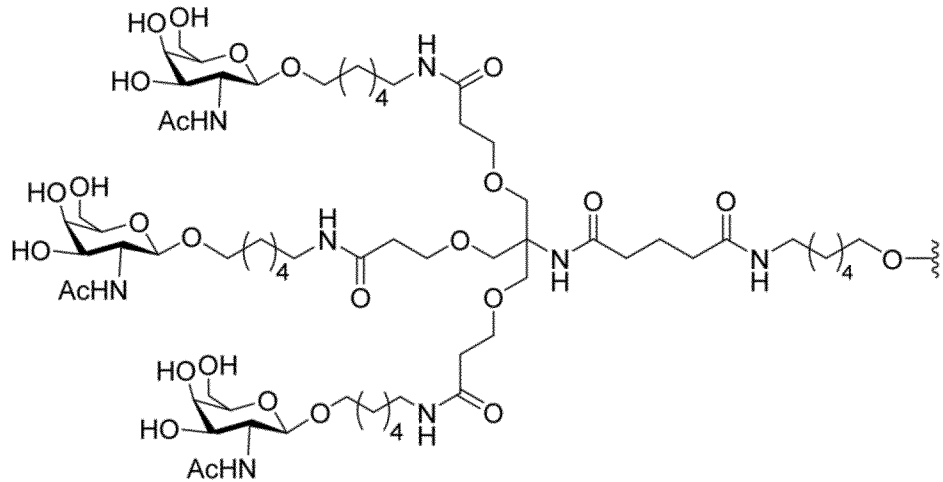

CERTIFICATE OF CORRECTION (continued)
U.S. Pat. No. 10,294,477 B2

In Claim 13, Column 715-718, the structure should read: